United States Patent 11,464,847 (LASSA VIRUS VACCINE) - sequence listing, part 3

SEQ ID NO: 4128 - RNA, 300 nt, Artificial Sequence
  derived and/or modified CDS sequence (opt3) from Lassa virus__AIT17402__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcggcucagccuucugccccaucgacugaaacgauucagaauaccacacccccuccauauacucccuga

SEQ ID NO: 4129 - RNA, 300 nt, Artificial Sequence
  derived and/or modified CDS sequence (opt3) from Lassa virus__AIT17406__Z
augggcaacagacaggccaagagcuccaaaguggacgagcaccaaagggcucaucugguccccgaugcaucucaccucgggccucaguucugcaagucauguugguuugaaaauaaaggacuuguugagugcaacaaucauuaccuguguuugaacugcuuaagucugcuacucagcguguccucucgguguccaaucugcaagaugccgcugcccaccaaacuuaaggccgcggcucagccuucggccccaucaacagaagcaguacagaauacugcucccccuccauaugcccccuga

SEQ ID NO: 4130 - RNA, 300 nt, Artificial Sequence
  derived and/or modified CDS sequence (opt3) from Lassa virus__AIT17410__Z
augggcaacaagcaggccaaaagcaccaagguggacgagcaccaaagagcucaucugguccccgaugcaucccaccucgggccucaguucugcaaaucuuguugguuugaaaauaggggacuuguugagugcaacaaucauuaccuguguuugaacugcuuaucacugcuacucagugugagcucccgguguccaaucugcaagaugccgcugcccacacgccuuaaagccgcgacucagccuucugcuccaucgacggaagccacccagaauacaacucccccuccauauacccccuga

SEQ ID NO: 4131 - RNA, 300 nt, Artificial Sequence
  derived and/or modified CDS sequence (opt3) from Lassa virus__AIT17418__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcgacucagccuucugcuccaucgacggaaaccauucagaauacaacucccccuccauauacccccuga

SEQ ID NO: 4132 - RNA, 300 nt, Artificial Sequence
  derived and/or modified CDS sequence (opt3) from Lassa virus__AIT17422__Z
augggcaacagacaggccaagagcgcuaaaguggacgagcaccaaagggcacaucugguccccgaugccucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccaccaaacuuaaggcggcuacacagccuucugccccaucgacugaagcaacgcagaauaccacacccccuccauauacucccuga

SEQ ID NO: 4133 - RNA, 300 nt, Artificial Sequence
  derived and/or modified CDS sequence (opt3) from Lassa virus__AIT17426__Z
augggcaacaagcaggccaaaagcaccaagguggacgagcaccaaagagcucaucugguccccgaugcaucccaccucgggccucaguucugcaaaucuuguugguuugaaaauaggggacuuguugagugcaacaaucauuaccuguguuugaacugcuuaucacugcuacucagugugagcucccgguguccaaucugcaagaugccgcugcccacaaaacuuaaggccgcgacucagccuucugcuccaucgacggaagccacccagaauacaacucccccuccauauacccccuga

SEQ ID NO: 4134 - RNA, 300 nt, Artificial Sequence
  derived and/or modified CDS sequence (opt3) from Lassa virus__AIT17432__Z
augggcaacaagcaggccaaaagcaccaagguggacgagcaccaaagagcucaucugguccccgaugcaucccaccucgggccucaguucugcaaaucuuguugguuugaaaauaggggacuuguugagugcaacaaucauuaccuguguuugaacugcuuaucacugcuacucagugugagcucccgguguccaaucugcaagaugccgcugcccacacgccuuaaagccgcgacucagccuucugcuccaucgacggaagccacccagaauacaauucccccuccauauacucccuga

SEQ ID NO: 4135 - RNA, 300 nt, Artificial Sequence
  derived and/or modified CDS sequence (opt3) from Lassa virus__AIT17436__Z
augggcaacaagcaggccaaaagcaccaaggcugacgagcaccaaagagcacaucuggugcccgaugccucccaccucgggccucaguucugcaaaucuuguugguuugaaaauaggggacuugucgagugcaacaaucauuaccuguguuugaacugcuuaucacugcuacucaguguuagcucccgguguccaaucugcaagaugccgcugcccacaaaacuuaaggcggcuacucagccuucugccccaucgacggaagcaacccgcaauacaacucccccuccauauacccccuga

SEQ ID NO: 4136 - RNA, 300 nt, Artificial Sequence
  derived and/or modified CDS sequence (opt3) from Lassa virus__AIT17444__Z
augggcaacagacaggccaagagcaccaaaguggacgagcaccaaagggcucaucugguccccgaugcaucccaccucgggccucaguucugcaagucuuguugguuugaaaauaaaggacuuguugagugcaacaaucauuaccuguguuugaacugcuuaucacugcuacucagugugagcucccgguguccaaucugcaagaugccgcugcccacaaaacuuaaggccgcggcucagccuucugccccaucgacugaagcagcccagaauacggcucccccuccauaugcacccuga

SEQ ID NO: 4137 - RNA, 300 nt, Artificial Sequence
  derived and/or modified CDS sequence (opt3) from Lassa virus__AIT17448__Z
augggcaacagacaggccaagagcaccaaagugggggagcaccaaagggcucaucugguccccgacgcaucccaccucggaccucaguucugcaagucuuguugguuugaaaaucggggucuuguugagugcaacaaucauuaccuguguuugaacugcuuaucacugcuacucagugugagcucccgcuguccaaucugcaaaaugccgcugcccacaaaacuuaaggccacugcgcagccuucugcuccaucggccgaagcaauucagaauacgacacccccuccauauacccccuga

SEQ ID NO: 4138 - RNA, 300 nt, Artificial Sequence
  derived and/or modified CDS sequence (opt3) from Lassa virus__AIT17452__Z
augggcaacagacaggccaagagcaccaggguggacgagcaccaacgggcucaucugguccccgaugcaucccaccucgggccucaguucugcaaaucuuguugguuugaaaaucgcggacuuguugagugcaacaaucauuaccuguguuugaacugcuuaucacugcuacucagugugagcucccgauguccaaucugcaagaugccgcugcccacacgucuuagagccgcgguacagccuucugcuccaucgacugaaacgacccaggacacaacucccccuccauauucacccuga

SEQ ID NO: 4139 - RNA, 300 nt, Artificial Sequence
  derived and/or modified CDS sequence (opt3) from Lassa virus__AIT17456__Z
augggcaacagacaggccaagagcaccgaggugaaugaacaccaaagggcucaucugguccccgacgcaucccaccucgggccucaguucugcaaaucuuguugguuugagaaccggggacuuguugaaugcaauaaccauuaccuguguuugaauugcuuaucacugcuacucagugugagcucccgcuguccaaucugcaagaugccgcugcccacaaaacuuaaggccgcgacucagccuucugcuccaucgacggagguaacccagaacacagugcccccuccauauucacccuga

SEQ ID NO: 4140 - RNA, 300 nt, Artificial Sequence
  derived and/or modified CDS sequence (opt3) from Lassa virus__AIT17460__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcggcucagccuucugccccacccacugaagcaacgcagaauaccacaccuccacccuauacuccuuga

SEQ ID NO: 4141 - RNA, 300 nt, Artificial Sequence
  derived and/or modified CDS sequence (opt3) from Lassa virus__AIT17468__Z
augggcaacagacaggccaagcaaaccaaaguggacgagcaccagagggcucaucugguccccgaugcaagccaccucgggccucaguucugcaaguccuguugguuugaaaaucggggacuuguugagugcaacaaucauuaccuguguuugaacugcuuaucucugcuacucucaaucaguagccgcuguccaauuugcaaaaugccgcugcccacaaaacuuaaggccgcggcucagccuuccgccccaucuacugaagcaacgcaagacaccacacccccuccauauacucccuga

SEQ ID NO: 4142 - RNA, 300 nt, Artificial Sequence
  derived and/or modified CDS sequence (opt3) from Lassa virus__AIT17472__Z
augggcaacaagcagaccaaaagcacaaaggccgacgagcaccaaagagcucaucuggugcccgaugcaucccaccucgggccucaguucugcaaaucuuguugguuugaaaauaggggacuugucgagugcaacaaucauuaccuguguuugaacugcuuaucacugcuacucaguguuagcucccgguguccaaucugcaagaugccgcugcccacucgccuuaaagccgcggcucagccuucugccccaucgacggaagcaacccaggacacaacucccccuccauauacccccuga

SEQ ID NO: 4143 - RNA, 300 nt, Artificial Sequence
  derived and/or modified CDS sequence (opt3) from Lassa virus__AIT17476__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcggcucagccuucugccccaucggcagaagccauucagaauacuacgcccccuccauauacccccuga

SEQ ID NO: 4144 - RNA, 300 nt, Artificial Sequence
  derived and/or modified CDS sequence (opt3) from Lassa virus__AIT17480__Z
augggcaacagacacgccaagagcaccaaaguggacgagcaucagagggcucaccugguccccgaugcaucccaucucgggccucaauucugcaagucuuguugguuugaaaaucggggacuuguugagugcaacaaucacuaccuguguuugaacugcuuaucacugcuacucagugugagcucccgcuguccaaucugcaaaaugccgcugcccacaaaacuuaaggccgcggcucagccuucugccccaucgacugaaguaauucagucaacgacacccccuccauauacccccuga

SEQ ID NO: 4145 - RNA, 300 nt, Artificial Sequence
  derived and/or modified CDS sequence (opt3) from Lassa virus__AIT17484__Z
augggcaacagacacgccaagagcaccaaaguggacgagcaucagagggcucaccugguccccgaugcaucccaucucgggccucaauucugcaagucuuguugguuugaaaaucggggacuuguugagugcaacaaucacuaccuguguuugaacugcuuaucacugcuacucagugugagcucccgcuguccaaucugcaaaaugccgcugcccacaaaacuuaaggccgcggcucagccuucugccccaucgacugaagagauucagaauacgacacccccuccauauacccccuga

SEQ ID NO: 4146 - RNA, 300 nt, Artificial Sequence
  derived and/or modified CDS sequence (opt3) from Lassa virus__AIT17488__Z
augggcaacagacaggccaagcccaccaaaguggacgagcaccaaagggcucaucuggucccugaugcaagccaccucgggccacaguucugcaaguccuguugguuugaaaauaaaggacuuguugagugcaacaaucauuaccuguguuugaacugcuuaucucugcuacucucagugaguagccgguguccgaucugcaagaugccccugccuacaaaacuuaaggccgcggcucagccauccgcccccucuacugaagcagcccagaauacggcuccuccacccuaugcaccuuga

SEQ ID NO: 4147 - RNA, 300 nt, Artificial Sequence
  derived and/or modified CDS sequence (opt3) from Lassa virus__AIT17496__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacacgacuuaaggccgcgacucagccuucugcuccaucgacggaagccacccagacaacuacacccccuccauauacccccuga

SEQ ID NO: 4148 - RNA, 300 nt, Artificial Sequence
  derived and/or modified CDS sequence (opt3) from Lassa virus__AIT17500__Z
augggcaacagacagaccaagagcacaaaaguggacgagcaccaaagggcccaucugguccccgaugcuucccaccucgggccucaguucugcaagucuuguugguuugaaaauaaaggacuuguugagugcaacaaucauuaccuguguuugaacugcuuaucacugcuacucagugugagcucccgguguccaaucugcaagaugccgcugcccacuaaacuuaagacggcagcccagccuucugcgccacccaccgaagcugcccgcacaacugcaccuccacccuaugccccuuga

SEQ ID NO: 4149 - RNA, 300 nt, Artificial Sequence
  derived and/or modified CDS sequence (opt3) from Lassa virus__AIT17508__Z
augggcaacagacagaccaagagcacaaaaguggacgagcaccaaagggcccaucugguccccgaugcuucccaccucgggccucaguucugcaagucuuguugguuugaaaauaaaggacuuguugagugcaacaaucauuaccuguguuugaacugcuuaucacugcuacucagugugagcucccgguguccaaucugcaagaugccgcugcccacuaaacuuaaggcagccgcgcagccuucugcuccaucgacggaagccacccagaauacagcacccccuccauaugcccccuga

SEQ ID NO: 4150 - RNA, 300 nt, Artificial Sequence
  derived and/or modified CDS sequence (opt3) from Lassa virus__AIT17512__Z
augggcaacagacaggccaagagcaccaaaguguacgagcaccaaagggcucaucugguccccgacgcaucccaccucgggccucaguucugcaagucuuguugguuugaaaaucggggacuuguugagugcaacaaucauuaucuguguuugaacugcuuaucacugcuacucagugugagcucccgcuguccaaucugcaaaaugccgcugcccacacgacuuaaggccgcgacucagccuucugcuccaucgacggaagccacccagaauacaacucccccuccauacacccccuga

SEQ ID NO: 4151 - RNA, 300 nt, Artificial Sequence
  derived and/or modified CDS sequence (opt3) from Lassa virus__AIT17516__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaagacugccacgcagccuucugcgccacugaccgaagcuacacagaauacuacacccccuccauauacccccuga

SEQ ID NO: 4152 - RNA, 300 nt, Artificial Sequence
  derived and/or modified CDS sequence (opt3) from Lassa virus__AIT17520__Z
augggcaacaagcaggccaaaagcaccaagguggacgagcaccaaagagcucaucugguccccgaugcaucccaccucgggccucaguucugcaaaucuuguugguuugaaaauaggggacuuguugagugcaacaaucauuaccuguguuugaacugcuuaucacugcuacucagugugagcaaucgguguccaaucugcaagaugccgcugcccacaaaacuuaaggccgcggcucagccuuccgccccaucuacugaagcaacgcagaacaccacacccccuccauauacucccuga

SEQ ID NO: 4153 - RNA, 300 nt, Artificial Sequence
  derived and/or modified CDS sequence (opt3) from Lassa virus__AIT17526__Z
augggcaacagacaggccaagagcgccaaagugaccgagcaccaaagggcacaucugguccccgacgccucccaccucgggccucaguucugcaagucuuguugguuugaaaauaaaggacuuguugagugcaacaaucauuaccuguguuugaacugcuuaucacugcuacucagugugagcucccgguguccaaucugcaagaugccgcugcccacacgccuuaaagcggcuacucagccuucugccccaucggcagaagcuccccagucaacgaccccuccacccuauacaccuuga

SEQ ID NO: 4154 - RNA, 300 nt, Artificial Sequence
  derived and/or modified CDS sequence (opt3) from Lassa virus__AIT17536__Z
augggcaacagacagaccaggcccacagaggccacugaacaaagccgggcucaccuggugccugacgcaucccaucucgggccacaguucugcaagucuuguugguuugagaauaaaggacuugucgaaugcaacaaucacuaccuguguuugaacugcuuaucacugcuacucaguguuagcucccgcuguccgaucugcaagaugccccugccuacgcgacuuaaagccucugcgcagccaucggcucccccuaccgaggccccacagaauaaggcacccccuccauauacaccguga

SEQ ID NO: 4155 - RNA, 300 nt, Artificial Sequence
  derived and/or modified CDS sequence (opt3) from Lassa virus__AIT17542__Z
augggcaacagacaggucaagagcaccaagguggacgagcaccaaagggcccaucugauccccgaugcuucccaccucgggccucaguucugcaagucuuguugguuugaaaaucggggacuuguugagugcaacaaucauuaccuguguuugaacugcuuaucacugcuacucagugugagcucccgcuguccaauuugcaaaaugccgcugcccacaaaacuugaagcagccgcgcagccuucugcuccaucgacugaggccacgcaggacaccacacccccuccauauacucccuga

SEQ ID NO: 4156 - RNA, 300 nt, Artificial Sequence
  derived and/or modified CDS sequence (opt3) from Lassa virus__AIT17546__Z
augggcaacaagcaggccaaaagcaccaagguggacgagcaccaaagagcucaucugguccccgaugcaucccaccucgggccucaguucugcaaaucuuguugguuugaaaauaggggacuuguugagugcaacaaucauuaccuguguuugaacugcuuaucacugcuacucagugugagcucccgguguccaaucugcaagaugccgcugcccacaaaacuuaaggccgcggcucagccuucugccccaucgacugaaacgauucagaauaccacacccccuccauauacucccuga

SEQ ID NO: 4157 - RNA, 300 nt, Artificial Sequence
  derived and/or modified CDS sequence (opt3) from Lassa virus__AIT17550__Z
augggcaacagacaggccaagcaaaccaaaguggacgagcaccagagggcucaucugguccccgaugcaagccaccucgggccucaguucugcaaguccuguugguuugaaaaucggggacuuguugagugcaacaaucauuaccuguguuugaacugcuuaucucugcuacucucagugaguagccgcuguccaaucugcaaaaugccgcugcccacaaaacuuaaggccgcggcucagccuuccgccccaucuacugaaauuacgcaaaauaccacacccccuccauauacucccuga

SEQ ID NO: 4158 - RNA, 300 nt, Artificial Sequence
  derived and/or modified CDS sequence (opt3) from Lassa virus__AIT17554__Z
augggcaacagacaggccaagagcaccaaagcugacgagcaccaaagggcacaucuggugcccgaugccucccaccucgggccucaguucugcaagucuuguugguuugaaaaucggggacuugucgagugcaacaaucauuaccuguguuugaacugcuuaucacugcuacucaguguuagcaaucgcuguccaaucugcaaaaugccgcugcccacacgacuuaaggcggcugcccagccuuccgcaccaucuacugaagccacgcaggacaccacacccccuccauauacucccuga

SEQ ID NO: 4159 - RNA, 300 nt, Artificial Sequence
  derived and/or modified CDS sequence (opt3) from Lassa virus__AIT17558__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacacgacuuaaggccgcggcucagccuucugccccaucgacugaagcaauucguucaacgacacccccuccauauacccccuga

SEQ ID NO: 4160 - RNA, 300 nt, Artificial Sequence
  derived and/or modified CDS sequence (opt3) from Lassa virus__AIT17570__Z
augggcaacagacaggccaagagcgcuaaagugaaugagcaccaaagggcacaucugguccccgacgccucccaccucgggccucaguucugcaagucuuguugguuugaaaaccggggacuuguugagugcaauaaccauuaccuguguuugaauugcuuaucacugcuacucagugugagcucccgcuguccaaucugcaaaaugccgcugcccaccaaacuuaaggcggcugcccagccuucugcaccaucgacagaagccacucagaacauuacgcccccuccauauacccccuga

SEQ ID NO: 4161 - RNA, 300 nt, Artificial Sequence
  derived and/or modified CDS sequence (opt3) from Lassa virus__AIT17578__Z
augggcaacagacaggccaagagcaccaaaguggacgagcaccaaagggcucaucugguccccgaugcaucccaccucgggccucaguucugcaagucuuguugguuugaaaauaaaggacuuguugagugcaacaaucauuaccuguguuugaacugcuuaucacugcuacucagugugagcucccgguguccaaucugcaagaugccgcugcccacaaaacuucgcgccgcggcucagccuucugccccaucgacugaaucagcacagaauacggcucccccuccauaugcccccuga

SEQ ID NO: 4162 - RNA, 300 nt, Artificial Sequence
  derived and/or modified CDS sequence (opt3) from Lassa virus__AIT17586__Z
augggcaacaagcaggccaaaagcaccaagguggacgagcaccaaagagcucaucugguccccgaugcaucccaccucgggccucaguucugcaaaucuuguugguuugaaaauaggggacuuguugagugcaacaaucauuaccuguguuugaacugcuuaucacugcuacucagugugagcucccgguguccaaucugcaagaugccgcugcccacacgccuuaaagccgcggcucagccuucugccccaucgacugaaguaacgcagaauaccacacccccuccauauacucccuga

SEQ ID NO: 4163 - RNA, 300 nt, Artificial Sequence
  derived and/or modified CDS sequence (opt3) from Lassa virus__AIT17590__Z
augggcaacagacaggccaagagcaccaaaguggacgagcaccaaagggcucaucugguccccgaugcaucccaccucgggccucaguucugcaagucuuguugguuugaaaauaaaggacuuguugagugcaacaaucauuaccuguguuugaacugcuuaucacugcuacucagugugagcucccgguguccaaucugcaagaugccgcugcccacaaaacuugaagccacuacgcagccuucugcgccaucgaccgaggaaacacagucaacuacacccccuccauauacccccuga

SEQ ID NO: 4164 - RNA, 300 nt, Artificial Sequence
  derived and/or modified CDS sequence (opt3) from Lassa virus__AIT17602__Z
augggcaacaagcaggccaaaagcaccaagguggacgaguaccaaagagcucaccugguccccgaugcaucccaucucgggccucaguucugcaaaucuuguugguuugaaaauaggggacuuguugagugcaacaaucacuaucuguguuugaacugcuuaucacugcuacucagugugagcaaucgguguccaaucugcaagaugccgcugcccacacgccuuaaagccgcggcucagccuuccgccccacccacugaagcaacgcagaacaccacaccuccacccuacacuccuuga

SEQ ID NO: 4165 - RNA, 300 nt, Artificial Sequence
  derived and/or modified CDS sequence (opt3) from Lassa virus__AIT17610__Z
augggcaacagacaggccaagcccaccaaaguggacgagcaccaaagggcucagcuggucccugaugcaagccaucucgggccacaguucugcaaguccuguugguuugaaaaucggggacuuguugagugcaacaaucacuaccuguguuugaacugcuuaucucugcuacucucagugaguagccgcuguccgaucugcaaaaugccccugccuacaaaacuuaaggccgcgacucagccauccgcucccucuacggaagccacccaaaauucgacaccuccacccuauacuccuuga

SEQ ID NO: 4166 - RNA, 300 nt, Artificial Sequence
  derived and/or modified CDS sequence (opt3) from Lassa virus__AIT17614__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcgacucagccuucugcuccaucgacggaagccacccagaauacaacucccccuccauauacccccuga

SEQ ID NO: 4167 - RNA, 300 nt, Artificial Sequence
  derived and/or modified CDS sequence (opt3) from Lassa virus__AIT17618__Z
augggcaacagacaggccaagagcaccgagguggacgaacaccaaagggcucaucugguccccgaugcaucccaccucgggccucaguucugcaaaucuuguugguuugagaaucggggacuuguugaaugcaacaaucauuaccuguguuugaacugcuuaucacugcuacucagugugagcaaucgcuguccaaucugcaagaugccgcugcccacaaaacuuaaggccgcgacucagccuuccgcuccaucuacggaggccacccagaacacaacucccccuccauauacccccuga

SEQ ID NO: 4168 - RNA, 300 nt, Artificial Sequence
  derived and/or modified CDS sequence (opt3) from Lassa virus__AIT17622__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcgacucagccuucugcuccaucgacggaaguaacccagaauacaauucccccuccauauucacccuga

SEQ ID NO: 4169 - RNA, 300 nt, Artificial Sequence
  derived and/or modified CDS sequence (opt3) from Lassa virus__AIT17628__Z
augggcaacaagcaggccaaaagcaccaagaucgacgagcaccaaagagcucaucuggugcccgaugcaucccaccucgggccucaguucugcaaaucuuguugguuugaaaauaggggacuugucgagugcaacaaucauuaccuguguuugaacugcuuaucacugcuacucaguguuagcucccgguguccaauuugcaagaugccgcugcccacacgccuuaaagccgcgacucagccuucugcuccaucgacggaagccacccagaauacaacucccccuccauauacccccuga

SEQ ID NO: 4170 - RNA, 300 nt, Artificial Sequence
  derived and/or modified CDS sequence (opt3) from Lassa virus__AIT17632__Z
augggcaacagacaggccaagagcaccaaaguggacgagcaccaaagggcucaucugguccccgaugcaucccaccucgggccucaguucugcaagucuuguugguuugaaaauaaaggacuuguugagugcaacaaucauuaccuguguuugaacugcuuaucacugcuacucagugugagcucccgguguccaaucugcaagaugccgcugcccacaaaacuucgcgccacugcgcagccuucugcuccaucgacggaagccauucagaauaccacacccccuccauauacucccuga

SEQ ID NO: 4171 - RNA, 300 nt, Artificial Sequence
  derived and/or modified CDS sequence (opt3) from Lassa virus__AIT17636__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcggcucagccuucugccccaucgauugaaacuauacagaauacgacacccccuccauauacccccuga

SEQ ID NO: 4172 - RNA, 300 nt, Artificial Sequence
  derived and/or modified CDS sequence (opt3) from Lassa virus__AIT17640__Z
augggcaacagacaggccaagagcaccaaagugggggagcaccaaagggcucaucugguccccgacgcaucccaccucggaccucaguucugcaagucuuguugguuugaaaaucggggucuuguugagugcaacaaucauuaccuguguuugaacugcuuaucacugcuacucagugugagcucccgcuguccaaucugcaaaaugccgcugcccacaaaacuuaaggccgcggcucagccuucugccccaucgacugaagcaacgcaggauaccacacccccuccauauacucccuga

SEQ ID NO: 4173 - RNA, 300 nt, Artificial Sequence
  derived and/or modified CDS sequence (opt3) from Lassa virus__AIT17648__Z
augggcaacagacaggccaagagcaccaaaguggacgagcaccaaagggcucaucugguccccgaugcaucccaccucgggccucaguucugcaagucuuguugguuugaaaauaaaggacuuguugagugcaacaaucauuaccuguguuugaacugcuuaucacugcuacucagugugagcucccgguguccaaucugcaagaugccgcugcccacaaaacuuaaggccacuguacagccuucugcgccaucgacggaagcugcccagucaaccgcacccccuccauaugcccccuga

SEQ ID NO: 4174 - RNA, 300 nt, Artificial Sequence
  derived and/or modified CDS sequence (opt3) from Lassa virus__AIT17652__Z
augggcaacagacaggccaagagcaccaaagugggggagcaccaaagggcucaucugguccccgacgcaucccaccucggaccucaguucugcaagucuuguugguuugaaaaucggggucuuguugagugcaacaaucauuaccuguguuugaacugcuuaucacugcuacucagugugagcucccgcuguccaaucugcaaaaugccgcugcccacaaaacuuaaggccgcggcucagccuucugccccaucggcagaagccauucagaagacuacgcccccuccauauacccccuga

SEQ ID NO: 4175 - RNA, 300 nt, Artificial Sequence
  derived and/or modified CDS sequence (opt3) from Lassa virus__AIT17656__Z
augggcaacagacaggccaagagcaccaaaguggacgaucaccaaagggcucaucugguccccgacgcaucccaccucgggccucaguucugcaagucuuguugguuugagaaucggggacuuguugaaugcaacaaucauuaccuguguuugaacugcuuaucacugcuacucagugugagcucccgcuguccaaucugcaaaaugccgcugcccacaaaacuuaaggccgcggcucagccuucugccccaucgacugaggcagcccaggauacgacacccccuccauauacccccuga

SEQ ID NO: 4176 - RNA, 300 nt, Artificial Sequence
  derived and/or modified CDS sequence (opt3) from Lassa virus__AIT17660__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcaaucgcuguccaaucugcaaaaugccgcugcccaccaaacuuaaggccgcggcucagccuuccgccccaucuacugaagcaauucagaacacgacacccccuccauaugcccccuga

SEQ ID NO: 4177 - RNA, 300 nt, Artificial Sequence
  derived and/or modified CDS sequence (opt3) from Lassa virus__AIT17664__Z
augggcaacaagcaggccaagagcaccaagguggacgagcaccaaagagcucaucugguccccgaugcaucccaccucgggccucaguucugcaaaucuuguugguuugaaaauaagggacuuguugagugcaacaaucauuaccuguguuugaacugcuuaucacugcuacucagugugagcuccagguguccaaucugcaaaaugccgcugcccacaaaacuuaaggccgcggcucagccuucugccccaucgacugaagcagcccagaauacggcucccccuccauaugcacccuga

SEQ ID NO: 4178 - RNA, 300 nt, Artificial Sequence
  derived and/or modified CDS sequence (opt3) from Lassa virus__AIT17668__Z
augggcaacagacaggccaagagcaccaaaguggacgagcaccaaagggcucaucugguccccgaugcaucccaccucgggccucaguucugcaagucuuguugguuugaaaauaaaggacuuguugagugcaacaaucauuaccuguguuugaacugcuuaucacugcuacucagugugagcucccgguguccaaucugcaagaugccgcugcccacaaaacuuaagacuacggcccagccuucugcgccacccaccgaagcugccaagaauacagcaccuccacccuaugccccuuga

SEQ ID NO: 4179 - RNA, 300 nt, Artificial Sequence
  derived and/or modified CDS sequence (opt3) from Lassa virus__AIT17676__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcgacucagccuucugcuccaucgacggaaguaacccagaauacaacucccccuccauauacccccuga

SEQ ID NO: 4180 - RNA, 300 nt, Artificial Sequence
  derived and/or modified CDS sequence (opt3) from Lassa virus__AIT17680__Z
augggcaacagacaggccaagagcaccaaaaucgacgagcaccaaagggcucaucuggugcccgaugcaucccaccucgggccucaguucugcaagucuuguugguuugaaaaucggggacuugucgagugcaacaaucauuaccuguguuugaacugcuuaucacugcuacucaguguuagcucccgcuguccaauuugcaaaaugccgcugcccacaaaacuuaaggccgcggcucagccuucugccccaucgacugaagcaauacagaauacgacacccccuccauauacccccuga

SEQ ID NO: 4181 - RNA, 300 nt, Artificial Sequence
  derived and/or modified CDS sequence (opt3) from Lassa virus__AIT17684__Z
augggcaacagacaggccaagagcgcuaaaguggacgagcaccaaagggcacaucugguccccgaugccucccaccucgggccucaguucugcaagucuuguugguuugaaaauaaaggacuuguugagugcaacaaucauuaccuguguuugaacugcuuaucacugcuacucagugugagcugucggugcccaaucuguaagaugccgcugcccaccaaacuuaaggcggcuacacagccuuccgccccaucuacugaagcaacgcagaauaccacacccccuccauauacucccuga

SEQ ID NO: 4182 - RNA, 300 nt, Artificial Sequence
  derived and/or modified CDS sequence (opt3) from Lassa virus__AIT17692__Z
augggcaacagacacgccaagcccaccaaaguggacgagcaucagagggcucaccuggucccugaugcaagccaucucgggccacaauucugcaaguccuguugguuugaaaaucggggacuuguugagugcaacaaucacuaccuguguuugaacugcuuaucucugcuacucucagugaguagccgcuguccgaucugcaaaaugccccugccuacaaaacuuaaggccgcggcucagccauccgcccccucuacugaagcaauucagaauacgaccccuccacccuauacaccuuga

SEQ ID NO: 4183 - RNA, 300 nt, Artificial Sequence
  derived and/or modified CDS sequence (opt3) from Lassa virus__AIT17702__Z
augggcaacagacacgccaagagcaccaaaguggacgagcaucagagggcucaccugguccccgaugcaucccaucucgggccucaauucugcaagucuuguugguuugaaaaucggggacuuguugagugcaacaaucacuaccuguguuugaacugcuuaucacugcuacucagugugagcucccgcuguccaaucugcaaaaugccgcugcccacaaaacuuaaggccgcggcucagccuucugccccaucgacugaagcauuccagaauacgacacccccuccauauacccccuga

SEQ ID NO: 4184 - RNA, 300 nt, Artificial Sequence
  derived and/or modified CDS sequence (opt3) from Lassa virus__AIT17708__Z
augggcaacagacacgccaagagcaccaaaguggacgagcaucagagggcucaccugguccccgaugcaucccaucucgggccucaauucugcaagucuuguugguuugaaaaucggggacuuguugagugcaacaaucacuaccuguguuugaacugcuuaucacugcuacucagugugagcucccgcuguccaaucugcaaaaugccgcugcccacaaaacuuaaggccgcgacucagccuucugcuccaucgacggaagccauucagaauaccacacccccuccauauacucccuga

SEQ ID NO: 4185 - RNA, 300 nt, Artificial Sequence
  derived and/or modified CDS sequence (opt3) from Lassa virus__AIT17716__Z
augggcaacagacccgccaagagcaccaaaguggacgagcaccagagggcucaucuggucccugaugcaucccaccucgggccacaauucugcaagucuuguugguuugaaaaucggggacuuguugagugcaacaaucauuaccuguguuugaacugcuuaucacugcuacucagugugagcucccgcuguccgaucugcaaaaugccccugccuacaaaacuuaaggccgcggcucagccaucugcccccucgacugaagcaacgcagaauaccacaccuccacccuauacuccuuga

SEQ ID NO: 4186 - RNA, 300 nt, Artificial Sequence
  derived and/or modified CDS sequence (opt3) from Lassa virus__AIT17720__Z
augggcaacagacaggccaagcccaccaaaguggacgagcaccaaagggcucaucuggucccugaugcaagccaccucgggccacaguucugcaaguccuguugguuugaaaaucggggacuuguugagugcaacaaucauuaccuguguuugaacugcuuaucucugcuacucucagugaguagccgcuguccgaucugcaaaaugccccugccuacacgacuuaaggccgcggcucagccauccgcccccucuacugaagagacgcagaauaccacaccuccacccuauacuccuuga

SEQ ID NO: 4187 - RNA, 300 nt, Artificial Sequence
  derived and/or modified CDS sequence (opt3) from Lassa virus__AIT17730__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcggcucagccuucugccccacugacugaagcaauucagaauacgacacccccuccauauacccccuga

SEQ ID NO: 4188 - RNA, 300 nt, Artificial Sequence
  derived and/or modified CDS sequence (opt3) from Lassa virus__AIT17734__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcggcucagccuucugccccaucgacugaagcaauucagaauacgacacccccuccauauacccccuga

SEQ ID NO: 4189 - RNA, 300 nt, Artificial Sequence
  derived and/or modified CDS sequence (opt3) from Lassa virus__AIT17738__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcgacucugccuucugcuccaucgacggaaguaacccagaauacaacucccccuccacacucacccuga

SEQ ID NO: 4190 - RNA, 300 nt, Artificial Sequence
  derived and/or modified CDS sequence (opt3) from Lassa virus__AIT17750__Z
augggcaacagacaggccaagagcgcuaaagugaaugagcaccaaagggcacaucugguccccgacgccucccaccucgggccucaguucugcaagucuuguugguuugaaaaccggggacuuguugagugcaauaaccauuaccuguguuugaauugcuuaucacugcuacucagugugagcucccgcuguccaaucugcaaaaugccgcugcccaccaaacuuaaggcggcuacacagccuucugccccaucgacugaagcaacgcagaacaccacacccccuccauauacucccuga

SEQ ID NO: 4191 - RNA, 300 nt, Artificial Sequence
  derived and/or modified CDS sequence (opt3) from Lassa virus__AIT17754__Z
augggcaacagacaggccaagagcaccaaaguggacgagcaccaaagggcucaucugguccccgaugcaucccaccucgggccucaguucugcaagucuuguugguuugaaaauaaaggacuuguugagugcaacaaucauuaccuguguuugaacugcuuaucacugcuacucagugugagcucccgguguccaaucugcaagaugccgcugcccacaaaacuuaaggccucugcgcagccuucggcuccaucaacugaagccgcacagaauacggcucccccuccauaugcccccuga

SEQ ID NO: 4192 - RNA, 300 nt, Artificial Sequence
  derived and/or modified CDS sequence (opt3) from Lassa virus__AIT17760__Z
augggcaacagacaggccaagagcaccaggacagacgagcaccaacgggcucaucuggugcccgaugcaucccaccucgggccucaguucugcaaaucuuguugguuugaaaauaagggacuugucgagugcaacaaucauuaccuguguuugaacugcuuaucacugcuacucaguguuagcucccgcuguccaaucugcaaaaugccgcugcccacuaaacuuaaggccgcggcucagccuucugccccaucgacggaagcaggucagaauaccgcucccccuccauaugcccccuga

SEQ ID NO: 4193 - RNA, 300 nt, Artificial Sequence
  derived and/or modified CDS sequence (opt3) from Lassa virus__AIT17768__Z
augggcaacagacaggccaagagcgcuaccguggacgagugccaaagggcacaccugguccccgaugccuccuaccucgggccucaguucuguaaaucuugcugguuugaaaauaagggacuuguugaguguaacaaucauuaucugugcuugaacuguuuaucacugcuacucagugugagcucccggugcccaaucuguaaaaugccgcugcccacaaaacuuaaggcggcugcccagccuucugcaccaucgacucgcgccacgcagaauaccacacccccuccauacacucccuga

SEQ ID NO: 4194 - RNA, 300 nt, Artificial Sequence
  derived and/or modified CDS sequence (opt3) from Lassa virus__AIT17776__Z
augggcaacaagcaggccaaaagcaccaagguggacgagcaccaaagagcucaucugguccccgaugcaucccaccucgggccucaguucugcaaaucuuguugguuugaaaauaagggacuuguugagugcaacaaucauuaccuguguuugaacugcuuaucacugcuacucagugugagcuccagguguccaaucugcaaaaugccgcugcccacacggcuuaaggccgcggcucagccuucugccccaucgacugaagcaacgcagaaugccgcucccccuccauaugcacccuga

SEQ ID NO: 4195 - RNA, 300 nt, Artificial Sequence
  derived and/or modified CDS sequence (opt3) from Lassa virus__AIT17780__Z
augggcaacagacagaccaagagcacaaaaguggacgagcaccaaagggccuaccugguccccgaugcuucccuccuugggccucaguucugcaagucuuguugguuugaaaauaaaggacugguugagugcaacaaucauuauuuguguuuaaacugccugucacuacuccugagugugagcucccgguguccaaucugcaagaugccgcuucccacucgccugaaagcagccgcgcagccuucugcuccacccacggaagccauucagaauaccacaccuccacccuacacuccuuga

SEQ ID NO: 4196 - RNA, 300 nt, Artificial Sequence
  derived and/or modified CDS sequence (opt3) from Lassa virus__AIT17784__Z
augggcaacagacagaccaagcccacaaaaguggacgagcaccaaagggcccaucuggucccugaugcuagccaccucgggccacaguucugcaaguccuguugguuugaaaauaaaggacuuguugagugcaacaaucauuaccuguguuugaacugcuuaucucugcuacucucagugaguagccgguguccgaucugcaagaugccccugccuacuaaacuuaaggcaacggcccagccauccgcgcccucuaccgaagcugcccagaauacagcaccuccacccuaugccccuuga

SEQ ID NO: 4197 - RNA, 300 nt, Artificial Sequence
  derived and/or modified CDS sequence (opt3) from Lassa virus__AIT17788__Z
augggcaacagacaggucaagagcaccaaaguggacgagcaccaaagggcccaucugguucccgaugcuucccaccucgggccucaguucugcaagucuuguugguuugaaaaucggggacuuguggagugcaacaaucauuaccuguguuugaacugcuuaucacugcuacucaguguaagcucccgcuguccaaucugcaaaaugccgcugcccacaaaacuuaaggcagccacucagccuucugcgccacccacggaagcuacccagaagacaacuccuccacccuauaccccuuga

SEQ ID NO: 4198 - RNA, 300 nt, Artificial Sequence
  derived and/or modified CDS sequence (opt3) from Lassa virus__AIT17792__Z
augggcaacaagcaggccaaaagcaccaagguggacgagcaccaaagagcucaucugguccccgaugcaucccaccucgggccucaguucugcaaaucuuguugguuugaaaauaggggacuuguugagugcaacaaucauuaccuguguuugaacugcuuaucacugcuacucagugugagcggucgguguccaaucugcaagaugccgcugcccacaaaacuuaaggccacugcgcagccuuccgcuccaucuacggaagccacccagaauacaacucccccuccauauacccccuga

SEQ ID NO: 4199 - RNA, 300 nt, Artificial Sequence
  derived and/or modified CDS sequence (opt3) from Lassa virus__AIT17796__Z
augggcaacaagcaggccaaaagcaccaagguggacgagcaccaaagagcucaucugguccccgaugcaucccaccucgggccucaguucugcaaaucuuguugguuugaaaauaggggacuuguugagugcaacaaucauuaccuguguuugaacugcuuaucacugcuacucagugugagcucccgguguccaaucugcaagaugccgcugcccacaaaacuuaaggccgcggcucagccuucugccccaucgacugaagcaauucagaauacgacacccccuccauauacccccuga

SEQ ID NO: 4200 - RNA, 300 nt, Artificial Sequence
  derived and/or modified CDS sequence (opt3) from Lassa virus__AIT17800__Z
augggcaacaagcaggccaaggcucccgaggcaaaggacagcccuagagccucccugaucccagaugcgacccaccucgggccgcaauucugcaaaucuuguugguuugaaaauaagggacuuguggagugcaacaaucauuaccuguguuugaacugcuuaacacugcuacucucagucaguaauaggugucccauuugcaaaaugccucugccaacuaaacuucggcccagcgcuacgccuaccgccccacccacagaagcagccgacuccauacgcccuccaccguaucaccccuga

SEQ ID NO: 4201 - RNA, 300 nt, Artificial Sequence
  derived and/or modified CDS sequence (opt3) from Lassa virus__AIT17804__Z
augggcaacaagcaggccaaggcuagcgaggaaaagaacucccccagagcaucucugaucccugacgccacccaccucgggccacaauucugcaaaucauguugguuugagaauaagggacuuguggaaugcaauaaccauuaccuguguuugaauugcuuaacacugcuacucagugucagcaacagguguccgauuugcaaaaugccccugccuacuaaacuucggccauccacgacccccacagcgccuccaacuggugcugccgauucuauacgcccucccccauauucgccguga

SEQ ID NO: 4202 - RNA, 300 nt, Artificial Sequence
  derived and/or modified CDS sequence (opt3) from Lassa virus__AIT17808__Z
augggcaacaagcaggccaaagcucccgagagcaaggacuccccuagagcaucucugaucccagaugccacccaccucgggccgcaauucugcaaaucauguugguuugaaaauaagggacuuguggagugcaacaaucauuaccuguguuugaacugcuuaacacugcuacucagugucagcaauaggugucccauuugcaaaaugccucugccaacucggcuucgccccuccgcggcuccuacggccccacccaccggugcagccgacucuacacgaccuccaccguauucgcccuga

SEQ ID NO: 4203 - RNA, 303 nt, Artificial Sequence
  derived and/or modified CDS sequence (opt3) from Lassa virus__AIT17834__Z
augggcaacaagcagaccagaagcccucccaaaccagagcacccgaggcccacacugcucccugacgccucccaucuugggccacaauucugcaagucuuguugguuugaaaauaaaggacugguggagugcaacaaucacuacuuguguuuaaacugccugacucuacuccugucagucagugaucggugucccaucugcaagaugccucuuccaacgaaacuggcuguucgcacccagcccagcgcaccuccauugaaucaggguaacacacaguccucuccgcccccuuauucgccauga

SEQ ID NO: 4204 - RNA, 300 nt, Artificial Sequence
  derived and/or modified CDS sequence (opt3) from Lassa virus__AIT17838__Z
augggcaacaagcaggccaaggugcccgagagcaaggacuccccuagagcuucucugaucccagaugcaacccaccucgggccgcaauucugcaaaucauguugguuugaaaauaagggacuugucgagugcaacaaucauuaccuguguuugaacugcuuaacacugcuacucaguguuagcaauaggugucccauuugcaaaaugccucugccaacuaaacuuaagcccuccgccgcgccuacggcuccacccaccggugccgcagacucuauacggccuccaccguauucgcccuga

SEQ ID NO: 4205 - RNA, 300 nt, Artificial Sequence
  derived and/or modified CDS sequence (opt3) from Lassa virus__AIT17842__Z
augggcaacaagcaggccaaggugcccgagagcaaggacuccccuagagcuucucugaucccagaugcaacccaccucgggccgcaauucugcaaaucauguugguuugaaaauaagggacuugucgagugcaacaaucauuaccuguguuugaacugcuuaacacugcuacucaguguuagcaauaggugucccauuugcaaaaugccucugccaacuaaacuucggcccuccgccgcgccuacggcuccacccaccgguguggccgacucuauacgcccuccaccguauucgcccuga

SEQ ID NO: 4206 - RNA, 300 nt, Artificial Sequence
  derived and/or modified CDS sequence (opt3) from Lassa virus__ANH09743__Z
augggcaacaagcaggccaaagcuagcgagguggaagacgggcccagagcaucccugaucccugaugccacccaccucggaccacaauucugcaagucuuguugguuugagaauaaaucacuugucgaaugcaacaaucauuaccuguguuugaacugcuuaacacugcuacucaguguuagcaauagguguccgauuugcaagaugccccugccuacucggcuuaaaccauccgugguacccacggcgccuccaacccgcgcuggugacggcacacgacccccuccauauucuccguga

SEQ ID NO: 4207 - RNA, 300 nt, Artificial Sequence
  derived and/or modified CDS sequence (opt3) from Lassa virus__ANH09745__Z
augggcaacaagcagaccaaagcccccgagguggaagacgggccuagagcuagccugaucccagaugcaacacaccucggaccgcaauucugcaaguccuguugguuugagaauaaaggucuugucgaaugcaacaaucauuaccuguguuugaacugcuuaacucugcuacucucuguuucaaguaggugucccauuugcaagaugccucugccaacgcggcuuaaacccagcauagugccuaccgccccacccgcgcgcacaggcgagaauacucgaccuccaccguauucccccuga

SEQ ID NO: 4208 - RNA, 300 nt, Artificial Sequence
  derived and/or modified CDS sequence (opt3) from Lassa virus__ANH09749__Z
augggcaacaagcaggccaaagcucccgagguggaagacgggccuagagcaagccugaucccagaugccacccaccucggaccgcaauucugcaaguccuguugguuugagaauaggggucuugucgaaugcaacaaucauuaccuguguuugaacugcuuaacacugcuacucucuguuucaaaucggugucccauuugcaaaaugccucugccaacucgccuuaagcccagugugguaccuacggcgccacccaccggcgcugggggagacacacgaccuccaccguauagccccuga

SEQ ID NO: 4209 - RNA, 300 nt, Artificial Sequence
  derived and/or modified CDS sequence (opt3) from Lassa virus__ANH09751__Z
augggcaacaagcaggccaaagcucccaaggcagaggacgggccuagagccagccugaucccagaugcgacccaccucggaccgcaauucugcaaauccuguugguuugaaaauaagggucuuguggagugcaacaaucauuaccuguguuugaacugcuuaacacugcuacucucugucucaaauaggugucccauuugcaaaaugccucugccaacucggcuuaagcccaguguugugccuacggcuccacccaccggcgccgggggagacacacgcccuccaccgcacagccccuga

SEQ ID NO: 4210 - RNA, 300 nt, Artificial Sequence
  derived and/or modified CDS sequence (opt3) from Lassa virus__ANH09753__Z
augggcaacaagcaggccaaagcuagcgaggcagaagacgggcccagagccucccugaucccugaugcgacccaccucggaccacaauucugcaagucuuguugguuugagaauaaaggucuuguggaaugcaacaaucauuaccuguguuugaacugcuuaacacugcuacucucagucaguuccagguguccgauuugcaagaugccccugccuacucggcuucgcccaagcguugugcccacggcuccuucugccggcgcaggggacggaacccgaccacccccuuauucgccauga

SEQ ID NO: 4211 - RNA, 300 nt, Artificial Sequence
  derived and/or modified CDS sequence (opt3) from Lassa virus__ANH09755__Z
augggcaacaagcagaccaaaacaaucaagaaaacugacagccccagagccucccugauuccugaugcuucucacauggggccacaauucugcaagucauguugguuugagaauaggggacucguggaaugcaacaaucauuaccuuugucugaacugcuugaguuuacugcuaagcgucuccaaucgguguccgauaugcaaaaugccccucccuacgaagcugcgcgcaucuccaucgcccaccgccccuucaauccgagaggcgaacauuacaaauccacccccuuauagcccauga

SEQ ID NO: 4212 - RNA, 300 nt, Artificial Sequence
  derived and/or modified CDS sequence (opt3) from Lassa virus__ANH09759__Z
augggcaacaagcagaccaaaacaacuaagaaaacggacagccccagagccucccugaucccugaugcuucucacauggggccacaauucugcaagucauguugguuugagaauaggggacucguggaaugcaacaaucauuaccuuugucugaacugcuugaguuuacugcuaagcgucuccaaucgguguccgauuugcaaaaugccccucccuaccaagcugcgcgcaucuccaucgcccacagccccuucaauacgagaggcgaacaucacuaauccacccccuuauagcccauga

SEQ ID NO: 4213 - RNA, 300 nt, Artificial Sequence
  derived and/or modified CDS sequence (opt3) from Lassa virus__ANH09761__Z
augggcaacaaggggaccaaacccacacagaauagcgagccuuccagagccaaccuggugccagacgcuucuuaccucggaccgcaauucugcaagucauguugguuugaaaauaaaggucuugucgagugcaacaaucacuaucuguguuugaacugcuuaacuaugcugcuaaguguuagcaauaggugucccaucugcaagaugccucucccaacgaaaauuaaggcauccggcucucccucggccccuccaaccgaagcgaacucagcugugagcccucccccauacacaccguga

SEQ ID NO: 4214 - RNA, 300 nt, Artificial Sequence
  derived and/or modified CDS sequence (opt3) from Lassa virus__AMR44579__Z
augggcgccagacagaccaagcaaccccagaucgaggggagcccuagggcuucccuggugccagacgcaucucaccucggaccgcaguucugcaagucauguugguuugaaaacaagggucuugucgagugcaauaaccauuaccuguguuugaauugcuuaagucugcuacucagcguuuccaaccggugucccauuugcaaaaugccucugccaacaaaacuucgcgugucuucggcccccucagcgccuccagcugccacugcacagcccggcacgccuccaccguauagccccuga

SEQ ID NO: 4215 - RNA, 300 nt, Artificial Sequence
  derived and/or modified CDS sequence (opt3) from Lassa virus__AMZ00378__Z
augggcaacagacagaccaaggccacagaggcuaaagacagccccagggcaucccugaucccugaugccacucaccucgggccacaauucugcaagucuuguugguuugaaaauaaaggacuuguggagugcaacaaucauuaccuguguuugaacugcuuaacgcugcuacucucagucaguagccgguguccgauuugcaagaugccccugccuacccgccuuaaauccucuacaaauccaacugcgcccucggcuaagaccgaaucaagcauaaacccuccacccuauaguccuuga

SEQ ID NO: 4216 - RNA, 300 nt, Artificial Sequence
  derived and/or modified CDS sequence (opt4) from Lassa virus__ADY11072__Z
augggcaacaagcaggccaaggcccccgagagcaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccaccggcgccgccgacagcaucagacccccccccuacagccccuga

SEQ ID NO: 4217 - RNA, 300 nt, Artificial Sequence
  derived and/or modified CDS sequence (opt4) from Lassa virus__AAO59514__Z
augggcaacaagcaggugagaagcaugaagaagguggacagccccagagccagccugauccccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaagaccagcaccacccccaccgcccccagcaucagagaggccaacaccaccagccccccccccuacagccccuga

SEQ ID NO: 4218 - RNA, 300 nt, Artificial Sequence
  derived and/or modified CDS sequence (opt4) from Lassa virus__AAO59508__Z
augggcaacagacaggccaagaaccccgagguggagaacagccccagagccagccugauccccgacgccacccaccugggcccccaguucugcaagagcugcugguucgagaacaagggccugguggagugcaacaaccacuaccugugccugaacugccugagccugcugcugagcgugagcaacagaugccccaucugcaagaugccccugcccaccagacugagacccaccaccacccccaccgccccccagaucaucaaggagaacaccaccaaccccccccccuacacccccuga

SEQ ID NO: 4219 - RNA, 300 nt, Artificial Sequence
  derived and/or modified CDS sequence (opt4) from Lassa virus__AAO59510__Z
augggcaacaagcagaccaaggcccccgaggccaaggacagccccagagccagccugauccccgacgccaccuaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgccggcgccgcccacagcgccagacccccccccuacagccccuga

SEQ ID NO: 4220 - RNA, 300 nt, Artificial Sequence
  derived and/or modified CDS sequence (opt4) from Lassa virus__AAT48997__Z
augggcaacaagcaggccaaggcccccgagaccaagaacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgugcccaccgccccccccgcccaggugggcgacagaaccagacccccccccuacagccccuga

SEQ ID NO: 4221 - RNA, 300 nt, Artificial Sequence
  derived and/or modified CDS sequence (opt4) from Lassa virus__AAT49005__Z
augggcaacaagcaggccaaggcccccgagaccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccagacugagacccagcgccgugcccaccgccccccccgcccccgccggcgacagaaccaagcccccccccuacagccccuga

SEQ ID NO: 4222 - RNA, 300 nt, Artificial Sequence
  derived and/or modified CDS sequence (opt4) from Lassa virus__ADU56612__Z
augggcaacagacagaccagacccaccgaggccaccgagcagagcagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugaaggccagcgcccagcccagcgccccccccaccgaggccccccagaacaccacccccccccccuacacccccuga

SEQ ID NO: 4223 - RNA, 300 nt, Artificial Sequence
  derived and/or modified CDS sequence (opt4) from Lassa virus__ADU56616__Z
augggcggcaagcacaccaagcagcccagagagagcaacagccccagagccagccugauccccgacgccacccaccugggcccccaguucugcaagagcugcugguucgagaacaagggccugguggagugcaacaaccacuaccugugccugaacugccugagccugcugcugagcgugagcaacagaugccccaucugcaagaugccccugcccaccagacugagaaccagcaccaaccccaccgccccccagguggagcagaccggccccgccagccccccccccuacagccccuga

SEQ ID NO: 4224 - RNA, 300 nt, Artificial Sequence
  derived and/or modified CDS sequence (opt4) from Lassa virus__ADU56620__Z
augggcggcaagcacaccaagccccagagagagagcaacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccagacugagagccagcaccaaccccaccgccccccagguggagcaggugggccccaccaaccccccccccuacagccccuga

SEQ ID NO: 4225 - RNA, 300 nt, Artificial Sequence
  derived and/or modified CDS sequence (opt4) from Lassa virus__ADU56624__Z
augggcaacagacacgccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccauccagaacaccacccccccccccuacacccccuga

SEQ ID NO: 4226 - RNA, 300 nt, Artificial Sequence
  derived and/or modified CDS sequence (opt4) from Lassa virus__ADU56628__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccauccagaacaccacccccccccccuacgcccccuga

SEQ ID NO: 4227 - RNA, 300 nt, Artificial Sequence
  derived and/or modified CDS sequence (opt4) from Lassa virus__ADU56632__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccacccaggacaccacccccccccccuacacccccuga

SEQ ID NO: 4228 - RNA, 300 nt, Artificial Sequence
  derived and/or modified CDS sequence (opt4) from Lassa virus__ADU56644__Z
augggcaacagacagaccaaggcccccgaggccaagggcagccccagagccagccugauccccgacgccacccaccugggcccccaguucugcaagagcugcugguucgagaacaagggccugguggagugcaacgaccacuaccugugccugaacugccugacccugcugcugagcgugagcagcagaugccccaucugcaagaugccccugcccaccagacugagacccagcaccaaccccaccgccccccccgccagagccgagggcggcaucaaccccccccccuacagccccuga

SEQ ID NO: 4229 - RNA, 300 nt, Artificial Sequence
  derived and/or modified CDS sequence (opt4) from Lassa virus__AHC95545__Z
augggcaacaagcaggccaaggaccccaagaccgagagcagccccagagccagccugauccccgacgccacccaccugggcccccaguucugcaagagcugcugguucgagaacaagggccugguggagugcaacaaccacuaccugugccugaacugccugagccugcugcugagcgugagcaacagaugccccaucugcaagaugccccugcccaccaagcugaagcccaucaccacccccaccgccccccagaucaccagagagagcaucaccaaccccccccccuacacccccuga

SEQ ID NO: 4230 - RNA, 300 nt, Artificial Sequence
  derived and/or modified CDS sequence (opt4) from Lassa virus__AHC95547__Z
augggcaacagacaggccaaggaccccaagguggagagcagccccagagccagccugauccccgacgccacccaccugggcccccaguucugcaagagcugcugguucgagaacaagggccugguggagugcaacaaccacuaccugugccugaacugccugagccugcugcugagcgugagcaacagaugccccaucugcaagaugccccugcccaccagacugagacccaccaccaugcccaccgccccccagaucaucaaggagggcaccaccaaccccccccccuacacccccuga

SEQ ID NO: 4231 - RNA, 300 nt, Artificial Sequence
  derived and/or modified CDS sequence (opt4) from Lassa virus__AIT17124__Z
augggcaacaagcaggugaagacccccgaggccaaggacagccccagagccagccugauccccgacgccacccaccugggcccccaguucugcaagagcugcugguucgagaacaagggccugguggagugcaacaaccacuaccugugccugaacugccugacccugcugcugagcgugggcaacagaugccccaucugcaagaugccccugcccaccaagcugagacccagcgugacccccaccgccccccccaccagagccgccgacagcaucggccccccccccuacagccccuga

SEQ ID NO: 4232 - RNA, 300 nt, Artificial Sequence
  derived and/or modified CDS sequence (opt4) from Lassa virus__AIT17128__Z
augggcaacaagcaggccaagacccccgaggccaaggacagccccagagccaaccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccaccggcgccgccgacagcaucagacccccccccuacagccccuga

SEQ ID NO: 4233 - RNA, 300 nt, Artificial Sequence
  derived and/or modified CDS sequence (opt4) from Lassa virus__AIT17132__Z
augggcaacaagcaggccaaggcccccgaggccagagacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccacccccaccgccccccccaccgaggccgccgacagcaucagacccccccccuacagacccuga

SEQ ID NO: 4234 - RNA, 300 nt, Artificial Sequence
  derived and/or modified CDS sequence (opt4) from Lassa virus__AIT17136__Z
augggcaacaagcagaccaaggcccccgagagcaagaacagccccagagccagccugauccccgacgccaccuaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagaagcagcgccgcccccaccgccccccccaccggcgccgccgacagcaccaagcccccccccuacagccccuga

SEQ ID NO: 4235 - RNA, 300 nt, Artificial Sequence
  derived and/or modified CDS sequence (opt4) from Lassa virus__AIT17140__Z
augggcaacaagcaggccaaggcccccgagcccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgccggcgccguggacagcaccagacccccccccuacagccccuga

SEQ ID NO: 4236 - RNA, 300 nt, Artificial Sequence
  derived and/or modified CDS sequence (opt4) from Lassa virus__AIT17144__Z
augggcaacaagcaggccaagacccccgagagcaaggacagccccagagccagccugauccccgacgccacccaccugggcccccaguucugcaagagcugcugguucgagaacaagggccugguggagugcaacaaccacuaccugugccugaacugccugacccugcugcugggcgugagcaacagaugccccaucugcaagaugccccugcccaccaagcugagaagcagcguggcccccaccgccccccccaccggcgccguggacagcaucagacccccccccuacagccccuga

SEQ ID NO: 4237 - RNA, 300 nt, Artificial Sequence
  derived and/or modified CDS sequence (opt4) from Lassa virus__AIT17152__Z
augggcaacaagcaggccaagacccccgagaccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcaccgcccccaccgccccccccgccggcgccgccgacaacaccagacccccccccuacagccccuga

SEQ ID NO: 4238 - RNA, 300 nt, Artificial Sequence
  derived and/or modified CDS sequence (opt4) from Lassa virus__AIT17162__Z
augggcaacaagcaggccaaggccagcgagagcaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgugacccccaccgccccccccaccagaaccgccgacaacaccagacccccccccuacagccccuga

SEQ ID NO: 4239 - RNA, 300 nt, Artificial Sequence
  derived and/or modified CDS sequence (opt4) from Lassa virus__AIT17166__Z
augggcaacaagcaggccaaggcccccgaggccaaggacagccccagagccagccugauccccgacgccacccaccugggcccccaguucugcaagagcugcugguucgagaccaagggccugguggagugcaacaaccacuaccugugccugaacugccugacccugcugcugagcgugagcaacagaugccccaucugcaagaugccccugcccaccaagcugagacccagcgccacccccaccgccccccccaccgaggccgccgacagcaucggccccccccccuacagccccuga

SEQ ID NO: 4240 - RNA, 300 nt, Artificial Sequence
  derived and/or modified CDS sequence (opt4) from Lassa virus__AIT17170__Z
augggcaacaagcaggccaaggugcccgagagcaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgccggcgccgccgacagcaucagacccccccccuacagccccuga

SEQ ID NO: 4241 - RNA, 300 nt, Artificial Sequence
  derived and/or modified CDS sequence (opt4) from Lassa virus__AIT17174__Z
augggcaacaagcagaccaaggcccccgaggccaagggcagccccagagccagccugauccccgacgccacccaccugggcccccaguucugcaagagcugcugguucgagaacaagggccugguggagugcaacaaccacuaccugugccugaacugccugacccugcugcugagcgugagcagcagaugccccaucugcaagaugccccugcccaccaagcugagacccagcgccgugcccaccgccccccccaccaaggccgaggacaacaccagacccccccccuacagccccuga

SEQ ID NO: 4242 - RNA, 300 nt, Artificial Sequence
  derived and/or modified CDS sequence (opt4) from Lassa virus__AIT17178__Z
augggcaacaagcaggccaaggccagcgaggccaaggacagccccagagccagccugauccccgacgccacccaccugggcccccaguucugcaagagcugcugguucgagaacaagggccugguggagugcaacaaccacuaccugugccugaacugccugagccugcugcugagcgugagcagcagaugccccaucugcaagaugccccugcccaccagacugagacccagcaccgcccccaccgccccccccgccagagccggcgacaacaucaagcccccccccuacagccccuga

SEQ ID NO: 4243 - RNA, 300 nt, Artificial Sequence
  derived and/or modified CDS sequence (opt4) from Lassa virus__AIT17182__Z
augggcaacaagcaggccaaggugcccgaggugagagacagccccagagccagccugauccccgacgccacccaccugggcccccaguucugcaagagcugcugguucgagaacaagggccugguggagugcaacaaccacuaccugugccugaacugccugacccugcugcugagcgugagcagcagaugccccaucugcaagaugccccugcccaccaagcugagacccagcgccacccccaccgccccccccgccggcgccggcgacggcaccagacccccccccuacagccccuga

SEQ ID NO: 4244 - RNA, 300 nt, Artificial Sequence
  derived and/or modified CDS sequence (opt4) from Lassa virus__AIT17186__Z
augggcaacaagcaggccaagacccccgagaccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcguggcccccaccgccccccccgccggcgccgccgacaacaccagacccccccccuacagccccuga

SEQ ID NO: 4245 - RNA, 300 nt, Artificial Sequence
  derived and/or modified CDS sequence (opt4) from Lassa virus__AIT17194__Z
augggcaacaagcaggccaaggcccccgagcccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcguggcccccaccgccccccccgccggcgugguggacagcaccagacccccccccuacagccccuga

SEQ ID NO: 4246 - RNA, 300 nt, Artificial Sequence
  derived and/or modified CDS sequence (opt4) from Lassa virus__AIT17198__Z
augggcaacaagcaggccaaggugcccgagagcaaggacagccccagagccagccugauccccgacgccacccaccugggcccccaguucugcaagagcugcugguucgagaacagaggccugguggagugcaacaaccacuaccugugccugaacugccugacccugcugcugagcgugagcaacagaugccccaucugcaagaugccccugcccaccaagcugagacccagcaccgcccccaccgccccccccaccggcgccgccgacagcaccagacccccccccuacagccccuga

SEQ ID NO: 4247 - RNA, 300 nt, Artificial Sequence
  derived and/or modified CDS sequence (opt4) from Lassa virus__AIT17202__Z
augggcaacaagcaggccaagacccccgagagcaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccagacugagacccagcgccgcccccaccgccccccccagcggcgccgccgacagcaccagacccccccccuacagccccuga

SEQ ID NO: 4248 - RNA, 300 nt, Artificial Sequence
  derived and/or modified CDS sequence (opt4) from Lassa virus__AIT17206__Z
augggcaacaagcaggccaaggcccccgaggccaaggacagccccagagccagccugauccccgacgccacccaccugggcccccaguucugcaagagcugcugguucgagaacaagggccugguggagugcaacaaccacuaccugugccugaacugccugacccugcugcugagcgugagcuacagaugccccaucugcaagaugccccugcccaccaagcugagacccagcgccacccccaccgccccccccaccgaggccgccgacagcaucagacccccccccuacagacccuga

SEQ ID NO: 4249 - RNA, 300 nt, Artificial Sequence
  derived and/or modified CDS sequence (opt4) from Lassa virus__AIT17214__Z
augggcaacaagcaggccaaggcccccgaggugaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccaccggcaccgccgacagcaucagacccccccccuacagccccuga

SEQ ID NO: 4250 - RNA, 300 nt, Artificial Sequence
  derived and/or modified CDS sequence (opt4) from Lassa virus__AIT17222__Z
augggcaacaagcaggccaagacccccgagaccaaggacagccccagagccagccugauccccgacgccacccaccugggcccccaguucugcaagagcugcugguucgagaacaagggccugguggagugcaacagccacuaccugugccugaacugccugacccugcugcugagcgugagcagcagaugccccaucugcaagaugccccugcccaccagacugagacccagcaccgcccccaccgccccccccgccggcgugggcgacagcaccagccccccccccuacagccccuga

SEQ ID NO: 4251 - RNA, 300 nt, Artificial Sequence
  derived and/or modified CDS sequence (opt4) from Lassa virus__AIT17226__Z
augggcaacaagcaggccaagacccccgaggccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccacccccaccgccccccccgccggcgccgccgacagcaucggccccccccccuacagccccuga

SEQ ID NO: 4252 - RNA, 297 nt, Artificial Sequence
  derived and/or modified CDS sequence (opt4) from Lassa virus__AIT17230__Z
augggcaacaagcaggccaaggccagcgacaagaacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccacccccaccgccccccccaccggcgccgccgacagcaucagacccccccccuacagccccuga

SEQ ID NO: 4253 - RNA, 300 nt, Artificial Sequence
  derived and/or modified CDS sequence (opt4) from Lassa virus__AIT17234__Z
augggcaacaagcaggccaaggccagcgaggagaagaacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccacccccaccgccccccccaccggcgccgccgacagcaucagacccccccccuacagccccuga

SEQ ID NO: 4254 - RNA, 300 nt, Artificial Sequence
  derived and/or modified CDS sequence (opt4) from Lassa virus__AIT17238__Z
augggcaacaagcagaccaaggcccccgaggccaagggcagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccacccccaccgccccccccaccgaggccgccgacagcaucagacccccccccuacagacccuga

SEQ ID NO: 4255 - RNA, 300 nt, Artificial Sequence
  derived and/or modified CDS sequence (opt4) from Lassa virus__AIT17242__Z
augggcaacaagcaggccaaggcccccgagagcaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccagacugagacccagcgccgcccccaccgccccccccaccggcgccaccgacagcaccagacccccccccuacagccccuga

SEQ ID NO: 4256 - RNA, 300 nt, Artificial Sequence
  derived and/or modified CDS sequence (opt4) from Lassa virus__AIT17248__Z
augggcaacaagcaggugaaggcccccgaggccagaaacagccccagagccagccugauccccgacgccacccaccugggcccccaguucugcaagagcugcugguucgagaacaagggccugguggagugcaacaaccacuaccugugccugaacugccugacccugcugcugggcgugagcagcagaugccccaucugcaagaccccccugcccaccagacugagacccagcgccacccccaccgccccccccgccggcgccggcgacaacaccagacccccccccuacagccccuga

SEQ ID NO: 4257 - RNA, 300 nt, Artificial Sequence
  derived and/or modified CDS sequence (opt4) from Lassa virus__AIT17252__Z
augggcaacaagcaggccaaggcccccgaggccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcaccgcccccaccgccccccccgccggcgccgccgacagcaccagacccccccccuacagccccuga

SEQ ID NO: 4258 - RNA, 300 nt, Artificial Sequence
  derived and/or modified CDS sequence (opt4) from Lassa virus__AIT17256__Z
augggcaacaagcaggccaaggcccccgagaccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgugggcgccgccgacaacaccagacccccccccuacagccccuga

SEQ ID NO: 4259 - RNA, 300 nt, Artificial Sequence
  derived and/or modified CDS sequence (opt4) from Lassa virus__AIT17260__Z
augggcaacaagcaggccaaggcccccgagcugaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgccggcgccguggacagcaccagacccccccccuacagccccuga

SEQ ID NO: 4260 - RNA, 300 nt, Artificial Sequence
  derived and/or modified CDS sequence (opt4) from Lassa virus__AIT17268__Z
augggcaacaagcagaccaaggcccccgaggugaagggcagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugaagcccagcaccacccccaccgccccccccaccggcgccgccgacagcaucagacccccccccuacagccccuga

SEQ ID NO: 4261 - RNA, 300 nt, Artificial Sequence
  derived and/or modified CDS sequence (opt4) from Lassa virus__AIT17272__Z
augggcaacaagcaggugaagaccagcgaggccagagacagccccagagccagccugauccccgacgccaccgaccugggcccccaguucugcaagagcugcugguucgagaacaagggccugguggagugcaacaaccacuaccugugccugaacugccugacccugcugcugagcgugagcaacagaugccccaucugcaagaugccccugcccaccagacugagacccagcgccaaccccaccgccccccccgccgagaccggcgacagcaccagacccccccccuacagccccuga

SEQ ID NO: 4262 - RNA, 300 nt, Artificial Sequence
  derived and/or modified CDS sequence (opt4) from Lassa virus__AIT17278__Z
augggcagcaagcagaccaagacccccgaggugaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgccagagccgccgacgacaccagacccccccccuacagccccuga

SEQ ID NO: 4263 - RNA, 300 nt, Artificial Sequence
  derived and/or modified CDS sequence (opt4) from Lassa virus__AIT17282__Z
augggcaacaagcaggccaaggcccccgagcccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgccggcgccguggacagcaucagacccccccccuacagccccuga

SEQ ID NO: 4264 - RNA, 300 nt, Artificial Sequence
  derived and/or modified CDS sequence (opt4) from Lassa virus__AIT17286__Z
augggcaacaagcagaccaaggcccccgaggugaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcaccgcccccaccgccccccccgccggcaccauggacagcaccagacccccccccuacagccccuga

SEQ ID NO: 4265 - RNA, 300 nt, Artificial Sequence
  derived and/or modified CDS sequence (opt4) from Lassa virus__AIT17290__Z
augggcaacaagcaggccagagcccccgaggccaaggacagccccagagccagccugauccccgacgccacccaccugggcccccaguucugcaagagcugcugguucgagaacaagggccugguggagugcaacaaccacuaccugugccugaacugccugacccugcugcugagcgugagcagcagaugccccaucugcaagaugccccugcccaccagacugagacccagcgccauccccaccgccccccccgccggcaccggcgacagcagcagacccccccccuacagccccuga

SEQ ID NO: 4266 - RNA, 300 nt, Artificial Sequence
  derived and/or modified CDS sequence (opt4) from Lassa virus__AIT17296__Z
augggcaacaagcaggccaagacccccgagaucaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgccggcgccgccgacaucaccagacccccccccuacagccccuga

SEQ ID NO: 4267 - RNA, 300 nt, Artificial Sequence
  derived and/or modified CDS sequence (opt4) from Lassa virus__AIT17300__Z
augggcaacaagcaggugaaggcccccgaggccagaaacagccccagagccagccugauccccgacgccacccaccugggcccccaguucugcaagagcugcugguucgagaacaagggccugguggagugcaacaaccacuaccugugccugaacugccugacccugcugcugggcgugagcagcagaugccccaucugcaagaugccccugcccaccagacugagacccagcaccgcccccaccgccccccccgccggcgccggcgacaacaccagacccccccccuacagccccuga

SEQ ID NO: 4268 - RNA, 300 nt, Artificial Sequence
  derived and/or modified CDS sequence (opt4) from Lassa virus__AIT17312__Z
augggcaacaagcaggccaagacccccgagaccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgugggcgccgccgacagcaccagacccccccccuacagccccuga

SEQ ID NO: 4269 - RNA, 300 nt, Artificial Sequence
  derived and/or modified CDS sequence (opt4) from Lassa virus__AIT17316__Z
augggcaacaagcaggccaaggcccccgaggccagaaacagccccagagccagccugauccccgacgccacccaccugggcccccaguucugcaagagcugcugguucgagaacagaggccugguggagugcaacaaccacuaccugugccugaacugccugacccugcugcugagcgugagcagcagaugccccaucugcaagaugccccugcccaccagacugagacccagcgccgcccccaccgccccccccgccggcgccggcgacaacaccagacccccccccuacagccccuga

SEQ ID NO: 4270 - RNA, 300 nt, Artificial Sequence
  derived and/or modified CDS sequence (opt4) from Lassa virus__AIT17320__Z
augggcaacaagcaggccaaggcccccgaggccagaaacagccccagagccagccugauccccgacgccacccaccugggcccccaguucugcaagagcugcugguucgagaacaagggccugguggagugcaacaaccacuaccugugccugaacugccugacccugcugcugggcgugagcagcagaugccccaucugcaagaugccccugcccaccagacugagacccagcgccgcccccaccgccccccuggccgaggccggcgacaacaccagacccccccccuacagccccuga

SEQ ID NO: 4271 - RNA, 300 nt, Artificial Sequence
  derived and/or modified CDS sequence (opt4) from Lassa virus__AIT17326__Z
augggcaacaagcagagcaaggcccccgagagcagagacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccacccccaccgccccccccaccagagccgccgacagcaucagacccccccccuacagccccuga

SEQ ID NO: 4272 - RNA, 300 nt, Artificial Sequence
  derived and/or modified CDS sequence (opt4) from Lassa virus__AIT17330__Z
augggcaacaagcaggccaaggcccuggagagcaagaacagccccagagccagccugauccccgacgccaccuaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagaagcagcgccgcccccaccgccccccccaccggcgccgccgacggcaccaagcccccccccuacagccccuga

SEQ ID NO: 4273 - RNA, 300 nt, Artificial Sequence
  derived and/or modified CDS sequence (opt4) from Lassa virus__AIT17342__Z
augggcaacaagcaggccaaggccagcgaggccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcaccgcccccaccgccccccagaccggcgccgccgacagcaucagacccccccccuacagccccuga

SEQ ID NO: 4274 - RNA, 300 nt, Artificial Sequence
  derived and/or modified CDS sequence (opt4) from Lassa virus__AIT17346__Z
augggcaacaagcaggccaaggcccccgagaccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgugggcgccgccgacagcaccagacccccccccuacagccccuga

SEQ ID NO: 4275 - RNA, 300 nt, Artificial Sequence
  derived and/or modified CDS sequence (opt4) from Lassa virus__AIT17362__Z
augggcaacaagcaggccaaggcccccgagagcaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgccggcgccgccgacagcaucagacccccccccuacagccccuga

SEQ ID NO: 4276 - RNA, 300 nt, Artificial Sequence
  derived and/or modified CDS sequence (opt4) from Lassa virus__AIT17366__Z
augggcaacaagcagaccaagacccccgaggugaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgccagagccgccgacgacaccagacccccccccuacagccccuga

SEQ ID NO: 4277 - RNA, 300 nt, Artificial Sequence
  derived and/or modified CDS sequence (opt4) from Lassa virus__AIT17376__Z
augggcaacaagcaggccaaggcccccgagagcaaggacagccccagagccagccugauccccgacgccaccuaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagaagcagcguggcccccaccgccccccccaccagagccgccgacagcaccagacccccccccuacagccccuga

SEQ ID NO: 4278 - RNA, 300 nt, Artificial Sequence
  derived and/or modified CDS sequence (opt4) from Lassa virus__AIT17382__Z
augggcaacaagcagaccaagaccagcgaggugaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccgccagagccgccgacgacaccagacccccccccuacagccccuga

SEQ ID NO: 4279 - RNA, 300 nt, Artificial Sequence
  derived and/or modified CDS sequence (opt4) from Lassa virus__AIT17386__Z
augggcaacaagcaggccaagacccccgaggccagagacagccccagagccagccugauccccgacgccacccaccugggcccccaguucugcaagagcugcugguucgagaacaagggccugguggagugcaacaaccacuaccugugccugaacugccugacccugcugcugagcgugagcagcagaugccccaucugcaagaugccccugcccaccaagcugagacccagcgccacccccaccgccccccccgccggcgccggcgacggcaccagacccccccccuacagccccuga

SEQ ID NO: 4280 - RNA, 300 nt, Artificial Sequence
  derived and/or modified CDS sequence (opt4) from Lassa virus__AIT17396__Z
augggcaacaagcaggugaaggcccccgaggccagaaacagccccagagccagccugauccccgacgccacccaccugggcccccaguucugcaagagcugcugguucgagaacaagggccugguggagugcaacaaccacuaccugugccugaacugccugacccugcugcugggcgugagcagcagaugccccaucugcaagaugccccugcccaccagacugagacccagcgccgcccccaccgccccccccgccgaggccggcgacaacaccagacccccccccuacagccccuga

SEQ ID NO: 4281 - RNA, 300 nt, Artificial Sequence
  derived and/or modified CDS sequence (opt4) from Lassa virus__AIT17402__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgagaccauccagaacaccacccccccccccuacacccccuga

SEQ ID NO: 4282 - RNA, 300 nt, Artificial Sequence
  derived and/or modified CDS sequence (opt4) from Lassa virus__AIT17406__Z
augggcaacagacaggccaagagcagcaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccgugcagaacaccgcccccccccccuacgcccccuga

SEQ ID NO: 4283 - RNA, 300 nt, Artificial Sequence
  derived and/or modified CDS sequence (opt4) from Lassa virus__AIT17410__Z
augggcaacaagcaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugaaggccgccacccagcccagcgcccccagcaccgaggccacccagaacaccacccccccccccuacacccccuga

SEQ ID NO: 4284 - RNA, 300 nt, Artificial Sequence
  derived and/or modified CDS sequence (opt4) from Lassa virus__AIT17418__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgagaccauccagaacaccacccccccccccuacacccccuga

SEQ ID NO: 4285 - RNA, 300 nt, Artificial Sequence
  derived and/or modified CDS sequence (opt4) from Lassa virus__AIT17422__Z
augggcaacagacaggccaagagcgccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgaggccacccagaacaccacccccccccccuacacccccuga

SEQ ID NO: 4286 - RNA, 300 nt, Artificial Sequence
  derived and/or modified CDS sequence (opt4) from Lassa virus__AIT17426__Z
augggcaacaagcaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgaggccacccagaacaccacccccccccccuacacccccuga

SEQ ID NO: 4287 - RNA, 300 nt, Artificial Sequence
  derived and/or modified CDS sequence (opt4) from Lassa virus__AIT17432__Z
augggcaacaagcaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugaaggccgccacccagcccagcgcccccagcaccgaggccacccagaacaccauccccccccccuacacccccuga

SEQ ID NO: 4288 - RNA, 300 nt, Artificial Sequence
  derived and/or modified CDS sequence (opt4) from Lassa virus__AIT17436__Z
augggcaacaagcaggccaagagcaccaaggccgacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgaggccaccagaaacaccacccccccccccuacacccccuga

SEQ ID NO: 4289 - RNA, 300 nt, Artificial Sequence
  derived and/or modified CDS sequence (opt4) from Lassa virus__AIT17444__Z
augggcaacagacaggccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccgcccagaacaccgcccccccccccuacgcccccuga

SEQ ID NO: 4290 - RNA, 300 nt, Artificial Sequence
  derived and/or modified CDS sequence (opt4) from Lassa virus__AIT17448__Z
augggcaacagacaggccaagagcaccaaggugggcgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccaccgcccagcccagcgcccccagcgccgaggccauccagaacaccacccccccccccuacacccccuga

SEQ ID NO: 4291 - RNA, 300 nt, Artificial Sequence
  derived and/or modified CDS sequence (opt4) from Lassa virus__AIT17452__Z
augggcaacagacaggccaagagcaccagaguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugagagccgccgugcagcccagcgcccccagcaccgagaccacccaggacaccacccccccccccuacagccccuga

SEQ ID NO: 4292 - RNA, 300 nt, Artificial Sequence
  derived and/or modified CDS sequence (opt4) from Lassa virus__AIT17456__Z
augggcaacagacaggccaagagcaccgaggugaacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgaggugacccagaacaccgugcccccccccuacagccccuga

SEQ ID NO: 4293 - RNA, 300 nt, Artificial Sequence
  derived and/or modified CDS sequence (opt4) from Lassa virus__AIT17460__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgccccccccaccgaggccacccagaacaccacccccccccccuacacccccuga

SEQ ID NO: 4294 - RNA, 300 nt, Artificial Sequence
  derived and/or modified CDS sequence (opt4) from Lassa virus__AIT17468__Z
augggcaacagacaggccaagcagaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcaucagcagcagaugccccaucugcaagaugccccugcccaccaagcugaaggccgccgcccagcccagcgcccccagcaccgaggccacccaggacaccacccccccccccuacacccccuga

SEQ ID NO: 4295 - RNA, 300 nt, Artificial Sequence
  derived and/or modified CDS sequence (opt4) from Lassa virus__AIT17472__Z
augggcaacaagcagaccaagagcaccaaggccgacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugaaggccgccgcccagcccagcgcccccagcaccgaggccacccaggacaccacccccccccccuacacccccuga

SEQ ID NO: 4296 - RNA, 300 nt, Artificial Sequence
  derived and/or modified CDS sequence (opt4) from Lassa virus__AIT17476__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcgccgaggccauccagaacaccacccccccccccuacacccccuga

SEQ ID NO: 4297 - RNA, 300 nt, Artificial Sequence
  derived and/or modified CDS sequence (opt4) from Lassa virus__AIT17480__Z
augggcaacagacacgccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggugauccagagcaccacccccccccccuacacccccuga

SEQ ID NO: 4298 - RNA, 300 nt, Artificial Sequence
  derived and/or modified CDS sequence (opt4) from Lassa virus__AIT17484__Z
augggcaacagacacgccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggagauccagaacaccacccccccccccuacacccccuga

SEQ ID NO: 4299 - RNA, 300 nt, Artificial Sequence
  derived and/or modified CDS sequence (opt4) from Lassa virus__AIT17488__Z
augggcaacagacaggccaagcccaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccgcccagaacaccgcccccccccccuacgcccccuga

SEQ ID NO: 4300 - RNA, 300 nt, Artificial Sequence
  derived and/or modified CDS sequence (opt4) from Lassa virus__AIT17496__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugaaggccgccacccagcccagcgcccccagcaccgaggccacccagaccaccacccccccccccuacacccccuga

SEQ ID NO: 4301 - RNA, 300 nt, Artificial Sequence
  derived and/or modified CDS sequence (opt4) from Lassa virus__AIT17500__Z
augggcaacagacagaccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaagaccgccgcccagcccagcgccccccccaccgaggccgccagaaccaccgcccccccccccuacgcccccuga

SEQ ID NO: 4302 - RNA, 300 nt, Artificial Sequence
  derived and/or modified CDS sequence (opt4) from Lassa virus__AIT17508__Z
augggcaacagacagaccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccacccagaacaccgcccccccccccuacgcccccuga

SEQ ID NO: 4303 - RNA, 300 nt, Artificial Sequence
  derived and/or modified CDS sequence (opt4) from Lassa virus__AIT17512__Z
augggcaacagacaggccaagagcaccaagguguacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugaaggccgccacccagcccagcgcccccagcaccgaggccacccagaacaccacccccccccccuacacccccuga

SEQ ID NO: 4304 - RNA, 300 nt, Artificial Sequence
  derived and/or modified CDS sequence (opt4) from Lassa virus__AIT17516__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaagaccgccacccagcccagcgccccccugaccgaggccacccagaacaccacccccccccccuacacccccuga

SEQ ID NO: 4305 - RNA, 300 nt, Artificial Sequence
  derived and/or modified CDS sequence (opt4) from Lassa virus__AIT17520__Z
augggcaacaagcaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcaacagaugccccaucugcaagaugccccugcccaccaagcugaaggccgccgcccagcccagcgcccccagcaccgaggccacccagaacaccacccccccccccuacacccccuga

SEQ ID NO: 4306 - RNA, 300 nt, Artificial Sequence
  derived and/or modified CDS sequence (opt4) from Lassa virus__AIT17526__Z
augggcaacagacaggccaagagcgccaaggugaccgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccagacugaaggccgccacccagcccagcgcccccagcgccgaggccccccagagcaccacccccccccccuacacccccuga

SEQ ID NO: 4307 - RNA, 300 nt, Artificial Sequence
  derived and/or modified CDS sequence (opt4) from Lassa virus__AIT17536__Z
augggcaacagacagaccagacccaccgaggccaccgagcagagcagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccagacugaaggccagcgcccagcccagcgccccccccaccgaggccccccagaacaaggcccccccccccuacacccccuga

SEQ ID NO: 4308 - RNA, 300 nt, Artificial Sequence
  derived and/or modified CDS sequence (opt4) from Lassa virus__AIT17542__Z
augggcaacagacaggugaagagcaccaagguggacgagcaccagagagcccaccugauccccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcuggaggccgccgcccagcccagcgcccccagcaccgaggccacccaggacaccacccccccccccuacacccccuga

SEQ ID NO: 4309 - RNA, 300 nt, Artificial Sequence
  derived and/or modified CDS sequence (opt4) from Lassa virus__AIT17546__Z
augggcaacaagcaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgagaccauccagaacaccacccccccccccuacacccccuga

SEQ ID NO: 4310 - RNA, 300 nt, Artificial Sequence
  derived and/or modified CDS sequence (opt4) from Lassa virus__AIT17550__Z
augggcaacagacaggccaagcagaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgagaucacccagaacaccacccccccccccuacacccccuga

SEQ ID NO: 4311 - RNA, 300 nt, Artificial Sequence
  derived and/or modified CDS sequence (opt4) from Lassa virus__AIT17554__Z
augggcaacagacaggccaagagcaccaaggccgacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcaacagaugccccaucugcaagaugccccugcccaccagacugaaggccgccgcccagcccagcgcccccagcaccgaggccacccaggacaccacccccccccccuacacccccuga

SEQ ID NO: 4312 - RNA, 300 nt, Artificial Sequence
  derived and/or modified CDS sequence (opt4) from Lassa virus__AIT17558__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugaaggccgccgcccagcccagcgcccccagcaccgaggccaucagaagcaccacccccccccccuacacccccuga

SEQ ID NO: 4313 - RNA, 300 nt, Artificial Sequence
  derived and/or modified CDS sequence (opt4) from Lassa virus__AIT17570__Z
augggcaacagacaggccaagagcgccaaggugaacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccacccagaacaucacccccccccccuacacccccuga

SEQ ID NO: 4314 - RNA, 300 nt, Artificial Sequence
  derived and/or modified CDS sequence (opt4) from Lassa virus__AIT17578__Z
augggcaacagacaggccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugagagccgccgcccagcccagcgcccccagcaccgagagcgcccagaacaccgcccccccccccuacgcccccuga

SEQ ID NO: 4315 - RNA, 300 nt, Artificial Sequence
  derived and/or modified CDS sequence (opt4) from Lassa virus__AIT17586__Z
augggcaacaagcaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugaaggccgccgcccagcccagcgcccccagcaccgaggugacccagaacaccacccccccccccuacacccccuga

SEQ ID NO: 4316 - RNA, 300 nt, Artificial Sequence
  derived and/or modified CDS sequence (opt4) from Lassa virus__AIT17590__Z
augggcaacagacaggccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcuggaggccaccacccagcccagcgcccccagcaccgaggagacccagagcaccacccccccccccuacacccccuga

SEQ ID NO: 4317 - RNA, 300 nt, Artificial Sequence
  derived and/or modified CDS sequence (opt4) from Lassa virus__AIT17602__Z
augggcaacaagcaggccaagagcaccaagguggacgaguaccagagagcccaccuggugcccgacgccagccaccugggcccccaguucugcaagagcugcugguucgagaacagaggccugguggagugcaacaaccacuaccugugccugaacugccugagccugcugcugagcgugagcaacagaugccccaucugcaagaugccccugcccaccagacugaaggccgccgcccagcccagcgccccccccaccgaggccacccagaacaccacccccccccccuacacccccuga

SEQ ID NO: 4318 - RNA, 300 nt, Artificial Sequence
  derived and/or modified CDS sequence (opt4) from Lassa virus__AIT17610__Z
augggcaacagacaggccaagcccaccaagguggacgagcaccagagagcccagcuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgaggccacccagaacagcacccccccccccuacacccccuga

SEQ ID NO: 4319 - RNA, 300 nt, Artificial Sequence
  derived and/or modified CDS sequence (opt4) from Lassa virus__AIT17614__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgaggccacccagaacaccacccccccccccuacacccccuga

SEQ ID NO: 4320 - RNA, 300 nt, Artificial Sequence
  derived and/or modified CDS sequence (opt4) from Lassa virus__AIT17618__Z
augggcaacagacaggccaagagcaccgagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcaacagaugccccaucugcaagaugccccugcccaccaagcugaaggccgccacccagcccagcgcccccagcaccgaggccacccagaacaccacccccccccccuacacccccuga

SEQ ID NO: 4321 - RNA, 300 nt, Artificial Sequence
  derived and/or modified CDS sequence (opt4) from Lassa virus__AIT17622__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgaggugacccagaacaccauccccccccccuacagccccuga

SEQ ID NO: 4322 - RNA, 300 nt, Artificial Sequence
  derived and/or modified CDS sequence (opt4) from Lassa virus__AIT17628__Z
augggcaacaagcaggccaagagcaccaagaucgacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugaaggccgccacccagcccagcgcccccagcaccgaggccacccagaacaccacccccccccccuacacccccuga

SEQ ID NO: 4323 - RNA, 300 nt, Artificial Sequence
  derived and/or modified CDS sequence (opt4) from Lassa virus__AIT17632__Z
augggcaacagacaggccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugagagccaccgcccagcccagcgcccccagcaccgaggccauccagaacaccacccccccccccuacacccccuga

SEQ ID NO: 4324 - RNA, 300 nt, Artificial Sequence
  derived and/or modified CDS sequence (opt4) from Lassa virus__AIT17636__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaucgagaccauccagaacaccacccccccccccuacacccccuga

SEQ ID NO: 4325 - RNA, 300 nt, Artificial Sequence
  derived and/or modified CDS sequence (opt4) from Lassa virus__AIT17640__Z
augggcaacagacaggccaagagcaccaaggugggcgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccacccaggacaccacccccccccccuacacccccuga

SEQ ID NO: 4326 - RNA, 300 nt, Artificial Sequence
  derived and/or modified CDS sequence (opt4) from Lassa virus__AIT17648__Z
augggcaacagacaggccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaaggccaccgugcagcccagcgcccccagcaccgaggccgcccagagcaccgcccccccccccuacgcccccuga

SEQ ID NO: 4327 - RNA, 300 nt, Artificial Sequence
  derived and/or modified CDS sequence (opt4) from Lassa virus__AIT17652__Z
augggcaacagacaggccaagagcaccaaggugggcgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcgccgaggccauccagaagaccacccccccccccuacacccccuga

SEQ ID NO: 4328 - RNA, 300 nt, Artificial Sequence
  derived and/or modified CDS sequence (opt4) from Lassa virus__AIT17656__Z
augggcaacagacaggccaagagcaccaagguggacgaccaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccgcccaggacaccacccccccccccuacacccccuga

SEQ ID NO: 4329 - RNA, 300 nt, Artificial Sequence
  derived and/or modified CDS sequence (opt4) from Lassa virus__AIT17660__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcaacagaugccccaucugcaagaugccccugcccaccaagcugaaggccgccgcccagcccagcgcccccagcaccgaggccauccagaacaccacccccccccccuacgcccccuga

SEQ ID NO: 4330 - RNA, 300 nt, Artificial Sequence
  derived and/or modified CDS sequence (opt4) from Lassa virus__AIT17664__Z
augggcaacaagcaggccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccgcccagaacaccgcccccccccccuacgcccccuga

SEQ ID NO: 4331 - RNA, 300 nt, Artificial Sequence
  derived and/or modified CDS sequence (opt4) from Lassa virus__AIT17668__Z
augggcaacagacaggccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaagaccaccgcccagcccagcgccccccccaccgaggccgccaagaacaccgcccccccccccuacgcccccuga

SEQ ID NO: 4332 - RNA, 300 nt, Artificial Sequence
  derived and/or modified CDS sequence (opt4) from Lassa virus__AIT17676__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgaggugacccagaacaccacccccccccccuacacccccuga

SEQ ID NO: 4333 - RNA, 300 nt, Artificial Sequence
  derived and/or modified CDS sequence (opt4) from Lassa virus__AIT17680__Z
augggcaacagacaggccaagagcaccaagaucgacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccauccagaacaccacccccccccccuacacccccuga

SEQ ID NO: 4334 - RNA, 300 nt, Artificial Sequence
  derived and/or modified CDS sequence (opt4) from Lassa virus__AIT17684__Z
augggcaacagacaggccaagagcgccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcugcagaugccccaucugcaagaugccccugcccaccaagcugaaggccgccacccagcccagcgcccccagcaccgaggccacccagaacaccacccccccccccuacacccccuga

SEQ ID NO: 4335 - RNA, 300 nt, Artificial Sequence
  derived and/or modified CDS sequence (opt4) from Lassa virus__AIT17692__Z
augggcaacagacacgccaagcccaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccauccagaacaccacccccccccccuacacccccuga

SEQ ID NO: 4336 - RNA, 300 nt, Artificial Sequence
  derived and/or modified CDS sequence (opt4) from Lassa virus__AIT17702__Z
augggcaacagacacgccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccuuccagaacaccacccccccccccuacacccccuga

SEQ ID NO: 4337 - RNA, 300 nt, Artificial Sequence
  derived and/or modified CDS sequence (opt4) from Lassa virus__AIT17708__Z
augggcaacagacacgccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgaggccauccagaacaccacccccccccccuacacccccuga

SEQ ID NO: 4338 - RNA, 300 nt, Artificial Sequence
  derived and/or modified CDS sequence (opt4) from Lassa virus__AIT17716__Z
augggcaacagacccgccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccacccagaacaccacccccccccccuacacccccuga

SEQ ID NO: 4339 - RNA, 300 nt, Artificial Sequence
  derived and/or modified CDS sequence (opt4) from Lassa virus__AIT17720__Z
augggcaacagacaggccaagcccaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccagacugaaggccgccgcccagcccagcgcccccagcaccgaggagacccagaacaccacccccccccccuacacccccuga

SEQ ID NO: 4340 - RNA, 300 nt, Artificial Sequence
  derived and/or modified CDS sequence (opt4) from Lassa virus__AIT17730__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgccccccugaccgaggccauccagaacaccacccccccccccuacacccccuga

SEQ ID NO: 4341 - RNA, 300 nt, Artificial Sequence
  derived and/or modified CDS sequence (opt4) from Lassa virus__AIT17734__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccauccagaacaccacccccccccccuacacccccuga

SEQ ID NO: 4342 - RNA, 300 nt, Artificial Sequence
  derived and/or modified CDS sequence (opt4) from Lassa virus__AIT17738__Z
augggcaacagacaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccugcccagcgcccccagcaccgaggugacccagaacaccaccccccccccccacagccccuga

SEQ ID NO: 4343 - RNA, 300 nt, Artificial Sequence
  derived and/or modified CDS sequence (opt4) from Lassa virus__AIT17750__Z
augggcaacagacaggccaagagcgccaaggugaacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgcccccagcaccgaggccacccagaacaccacccccccccccuacacccccuga

SEQ ID NO: 4344 - RNA, 300 nt, Artificial Sequence
  derived and/or modified CDS sequence (opt4) from Lassa virus__AIT17754__Z
augggcaacagacaggccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaaggccagcgcccagcccagcgcccccagcaccgaggccgcccagaacaccgcccccccccccuacgcccccuga

SEQ ID NO: 4345 - RNA, 300 nt, Artificial Sequence
  derived and/or modified CDS sequence (opt4) from Lassa virus__AIT17760__Z
augggcaacagacaggccaagagcaccagaaccgacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccggccagaacaccgcccccccccccuacgcccccuga

SEQ ID NO: 4346 - RNA, 300 nt, Artificial Sequence
  derived and/or modified CDS sequence (opt4) from Lassa virus__AIT17768__Z
augggcaacagacaggccaagagcgccaccguggacgagugccagagagcccaccuggugcccgacgccagcuaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaaggccgccgcccagcccagcgcccccagcaccagagccacccagaacaccacccccccccccuacacccccuga

SEQ ID NO: 4347 - RNA, 300 nt, Artificial Sequence
  derived and/or modified CDS sequence (opt4) from Lassa virus__AIT17776__Z
augggcaacaagcaggccaagagcaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccagacugaaggccgccgcccagcccagcgcccccagcaccgaggccacccagaacgccgcccccccccccuacgcccccuga

SEQ ID NO: 4348 - RNA, 300 nt, Artificial Sequence
  derived and/or modified CDS sequence (opt4) from Lassa virus__AIT17780__Z
augggcaacagacagaccaagagcaccaagguggacgagcaccagagagccuaccuggugcccgacgccagccugcugggcccccaguucugcaagagcugcugguucgagaacaagggccugguggagugcaacaaccacuaccugugccugaacugccugagccugcugcugagcgugagcagcagaugccccaucugcaagaugccccugcccaccagacugaaggccgccgcccagcccagcgccccccccaccgaggccauccagaacaccacccccccccccuacacccccuga

SEQ ID NO: 4349 - RNA, 300 nt, Artificial Sequence
  derived and/or modified CDS sequence (opt4) from Lassa virus__AIT17784__Z
augggcaacagacagaccaagcccaccaagguggacgagcaccagagagcccaccuggugcccgacgccagccaccugggcccccaguucugcaagagcugcugguucgagaacaagggccugguggagugcaacaaccacuaccugugccugaacugccugagccugcugcugagcgugagcagcagaugccccaucugcaagaugccccugcccaccaagcugaaggccaccgcccagcccagcgcccccagcaccgaggccgcccagaacaccgcccccccccccuacgcccccuga

SEQ ID NO: 4350 - RNA, 300 nt, Artificial Sequence
  derived and/or modified CDS sequence (opt4) from Lassa virus__AIT17788__Z
augggcaacagacaggugaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccacccagcccagcgccccccccaccgaggccacccagaagaccacccccccccccuacacccccuga

SEQ ID NO: 4351 - RNA, 300 nt, Artificial Sequence
  derived and/or modified CDS sequence (opt4) from Lassa virus__AIT17792__Z
augggcaacaagcaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcggcagaugccccaucugcaagaugccccugcccaccaagcugaaggccaccgcccagcccagcgcccccagcaccgaggccacccagaacaccacccccccccccuacacccccuga

SEQ ID NO: 4352 - RNA, 300 nt, Artificial Sequence
  derived and/or modified CDS sequence (opt4) from Lassa virus__AIT17796__Z
augggcaacaagcaggccaagagcaccaagguggacgagcaccagagagcccaccuggugcccgacgccagccaccugggcccccaguucugcaagagcugcugguucgagaacagaggccugguggagugcaacaaccacuaccugugccugaacugccugagccugcugcugagcgugagcagcagaugccccaucugcaagaugccccugcccaccaagcugaaggccgccgcccagcccagcgcccccagcaccgaggccauccagaacaccacccccccccccuacacccccuga

SEQ ID NO: 4353 - RNA, 300 nt, Artificial Sequence
  derived and/or modified CDS sequence (opt4) from Lassa virus__AIT17800__Z
augggcaacaagcaggccaaggcccccgaggccaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccacccccaccgccccccccaccgaggccgccgacagcaucagacccccccccuaccaccccuga

SEQ ID NO: 4354 - RNA, 300 nt, Artificial Sequence
  derived and/or modified CDS sequence (opt4) from Lassa virus__AIT17804__Z
augggcaacaagcaggccaaggccagcgaggagaagaacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcaccacccccaccgccccccccaccggcgccgccgacagcaucagacccccccccuacagccccuga

SEQ ID NO: 4355 - RNA, 300 nt, Artificial Sequence
  derived and/or modified CDS sequence (opt4) from Lassa virus__AIT17808__Z
augggcaacaagcaggccaaggcccccgagagcaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccagacugagacccagcgccgcccccaccgccccccccaccggcgccgccgacagcaccagacccccccccuacagccccuga

SEQ ID NO: 4356 - RNA, 303 nt, Artificial Sequence
  derived and/or modified CDS sequence (opt4) from Lassa virus__AIT17834__Z
augggcaacaagcagaccagaagcccccccaagcccgagcaccccagacccacccugcugcccgacgccagccaccugggcccccaguucugcaagagcugcugguucgagaacaagggccugguggagugcaacaaccacuaccugugccugaacugccugacccugcugcugagcgugagcgacagaugccccaucugcaagaugccccugcccaccaagcuggccgugagaacccagcccagcgcccccccccugaaccagggcaacacccagagcagccccccccccuacagccccuga

SEQ ID NO: 4357 - RNA, 300 nt, Artificial Sequence
  derived and/or modified CDS sequence (opt4) from Lassa virus__AIT17838__Z
augggcaacaagcaggccaaggugcccgagagcaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugaagcccagcgccgcccccaccgccccccccaccggcgccgccgacagcaucagacccccccccuacagccccuga

SEQ ID NO: 4358 - RNA, 300 nt, Artificial Sequence
  derived and/or modified CDS sequence (opt4) from Lassa virus__AIT17842__Z
augggcaacaagcaggccaaggugcccgagagcaaggacagccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccaagcugagacccagcgccgcccccaccgccccccccaccggcguggccgacagcaucagacccccccccuacagccccuga

SEQ ID NO: 4359 - RNA, 300 nt, Artificial Sequence
  derived and/or modified CDS sequence (opt4) from Lassa virus__ANH09743__Z
augggcaacaagcaggccaaggccagcgagguggaggacggccccagagccagccugauccccgacgccacccaccugggcccccaguucugcaagagcugcugguucgagaacaagagccugguggagugcaacaaccacuaccugugccugaacugccugacccugcugcugagcgugagcaacagaugccccaucugcaagaugccccugcccaccagacugaagcccagcguggugcccaccgccccccccaccagagccggcgacggcaccagacccccccccuacagccccuga

SEQ ID NO: 4360 - RNA, 300 nt, Artificial Sequence
  derived and/or modified CDS sequence (opt4) from Lassa virus__ANH09745__Z
augggcaacaagcagaccaaggcccccgagguggaggacggccccagagccagccugauccccgacgccacccaccugggcccccaguucugcaagagcugcugguucgagaacaagggccugguggagugcaacaaccacuaccugugccugaacugccugacccugcugcugagcgugagcagcagaugccccaucugcaagaugccccugcccaccagacugaagcccagcaucgugcccaccgccccccccgccagaaccggcgagaacaccagacccccccccuacagccccuga

SEQ ID NO: 4361 - RNA, 300 nt, Artificial Sequence
  derived and/or modified CDS sequence (opt4) from Lassa virus__ANH09749__Z
augggcaacaagcaggccaaggcccccgagguggaggacggccccagagccagccugauccccgacgccacccaccugggcccccaguucugcaagagcugcugguucgagaacagaggccugguggagugcaacaaccacuaccugugccugaacugccugacccugcugcugagcgugagcaacagaugccccaucugcaagaugccccugcccaccagacugaagcccagcguggugcccaccgccccccccaccggcgccggcggcgacaccagacccccccccuacagccccuga

SEQ ID NO: 4362 - RNA, 300 nt, Artificial Sequence
  derived and/or modified CDS sequence (opt4) from Lassa virus__ANH09751__Z
augggcaacaagcaggccaaggcccccaaggccgaggacggccccagagccagccugauccccgacgccacccaccugggcccccaguucugcaagagcugcugguucgagaacaagggccugguggagugcaacaaccacuaccugugccugaacugccugacccugcugcugagcgugagcaacagaugccccaucugcaagaugccccugcccaccagacugaagcccagcguggugcccaccgccccccccaccggcgccggcggcgacaccagaccccccccccacagccccuga

SEQ ID NO: 4363 - RNA, 300 nt, Artificial Sequence
  derived and/or modified CDS sequence (opt4) from Lassa virus__ANH09753__Z
augggcaacaagcaggccaaggccagcgaggccgaggacggccccagagccagccugauccccgacgccacccaccugggcccccaguucugcaagagcugcugguucgagaacaagggccugguggagugcaacaaccacuaccugugccugaacugccugacccugcugcugagcgugagcagcagaugccccaucugcaagaugccccugcccaccagacugagacccagcguggugcccaccgcccccagcgccggcgccggcgacggcaccagacccccccccuacagccccuga

SEQ ID NO: 4364 - RNA, 300 nt, Artificial Sequence
  derived and/or modified CDS sequence (opt4) from Lassa virus__ANH09755__Z
augggcaacaagcagaccaagaccaucaagaagaccgacagccccagagccagccugauccccgacgccagccacaugggcccccaguucugcaagagcugcugguucgagaacagaggccugguggagugcaacaaccacuaccugugccugaacugccugagccugcugcugagcgugagcaacagaugccccaucugcaagaugccccugcccaccaagcugagagccagccccagccccaccgcccccagcaucagagaggccaacaucaccaaccccccccccuacagccccuga

SEQ ID NO: 4365 - RNA, 300 nt, Artificial Sequence
  derived and/or modified CDS sequence (opt4) from Lassa virus__ANH09759__Z
augggcaacaagcagaccaagaccaccaagaagaccgacagccccagagccagccugauccccgacgccagccacaugggcccccaguucugcaagagcugcugguucgagaacagaggccugguggagugcaacaaccacuaccugugccugaacugccugagccugcugcugagcgugagcaacagaugccccaucugcaagaugccccugcccaccaagcugagagccagccccagccccaccgcccccagcaucagagaggccaacaucaccaaccccccccccuacagccccuga

SEQ ID NO: 4366 - RNA, 300 nt, Artificial Sequence
  derived and/or modified CDS sequence (opt4) from Lassa virus__ANH09761__Z
augggcaacaagggcaccaagcccacccagaacagcgagcccagcagagccaaccuggugcccgacgccagcuaccugggcccccaguucugcaagagcugcugguucgagaacaagggccugguggagugcaacaaccacuaccugugccugaacugccugaccaugcugcugagcgugagcaacagaugccccaucugcaagaugccccugcccaccaagaucaaggccagcggcagccccagcgccccccccaccgaggccaacagcgccgugagccccccccccuacacccccuga

SEQ ID NO: 4367 - RNA, 300 nt, Artificial Sequence
  derived and/or modified CDS sequence (opt4) from Lassa virus__AMR44579__Z
augggcgccagacagaccaagcagccccagaucgagggcagccccagagccagccuggugcccgacgccagccaccugggcccccaguucugcaagagcugcugguucgagaacaagggccugguggagugcaacaaccacuaccugugccugaacugccugagccugcugcugagcgugagcaacagaugccccaucugcaagaugccccugcccaccaagcugagagugagcagcgcccccagcgccccccccgccgccaccgcccagcccggcacccccccccccuacagccccuga

SEQ ID NO: 4368 - RNA, 300 nt, Artificial Sequence
  derived and/or modified CDS sequence (opt4) from Lassa virus__AMZ00378__Z
augggcaacagacagaccaaggccaccgaggccaaggacagccccagagccagccugauccccgacgccacccaccugggcccccaguucugcaagagcugcugguucgagaacaagggccugguggagugcaacaaccacuaccugugccugaacugccugacccugcugcugagcgugagcagcagaugccccaucugcaagaugccccugcccaccagacugaagagcagcaccaaccccaccgcccccagcgccaagaccgagagcagcaucaaccccccccccuacagccccuga

SEQ ID NO: 4369 - RNA, 300 nt, Artificial Sequence
  derived and/or modified CDS sequence (opt5) from Lassa virus__ADY11072__Z
augggcaacaagcaggccaaagcucccgagagcaaggacuccccuagagccucucugaucccggaugcgacccaccucgggccccaauucugcaaaagcuguugguuugaaaauaagggacugguggagugcaacaaucauuaccuuugucugaacugccucacacugcuucuguccgucucuaaucgguguccuauuugcaaaaugccccucccuacgaagcugcgccccagcgcugccccuaccgccccgcccacaggcgcugccgacuccaucagaccucccccuuauucucccuga

SEQ ID NO: 4370 - RNA, 300 nt, Artificial Sequence
  derived and/or modified CDS sequence (opt5) from Lassa virus__AAO59514__Z
augggcaacaaacaggugagaagcaugaagaaggucgacucuccccgggccucccugaucccugaugcuagccaccucgggccgcaauucugcaaauccuguugguuugagaaucgcggacugguugaaugcaacaaucauuaccuuugucugaacugccucucucugcuucugagcguguccucuagaugucccauuugcaagaugccucuccccaccaaacugaagacaagcacgaccccuacagcccccuccauccgggaggcgaauaccacaagcccuccgcccuauucuccuuga

SEQ ID NO: 4371 - RNA, 300 nt, Artificial Sequence
  derived and/or modified CDS sequence (opt5) from Lassa virus__AAO59508__Z
augggcaacagacaggccaagaaucccgagguggaaaacagcccucgggcuucccugaucccggacgccacccaccucgggccccaauucugcaaaucuuguugguuugagaauaagggacuggucgaaugcaacaaucauuaccuuugucugaacugccucagccugcuucuguccguuucuaaucgcuguccuauuugcaaaaugccccucccuacaagacugcggcccacgaccacaccuaccgcgccgcagaucauuaaggagaacacaaccaaucccccucccuauacaccuuga

SEQ ID NO: 4372 - RNA, 300 nt, Artificial Sequence
  derived and/or modified CDS sequence (opt5) from Lassa virus__AAO59510__Z
augggcaacaagcagaccaaagcccccgaggcuaaggacagcccuagagccucccugaucccggaugcgacauaccucgggccccaauucugcaaaucuuguugguuugaaaauaagggacugguggagugcaacaaucacuaucuuugucugaacugccucacgcugcuucugagcgucuccaaucgguguccuauuugcaaaaugccccucccuaccaagcugcgccccucugcugccccuacagccccgcccgcuggcgccgcucauagcgccagaccucccccuuacucccccuga

SEQ ID NO: 4373 - RNA, 300 nt, Artificial Sequence
  derived and/or modified CDS sequence (opt5) from Lassa virus__AAT48997__Z
augggcaacaagcaggccaaagcucccgagaccaagaauagcccuagagccucccugaucccggacgcgacacaccucgggccccaauucugcaaaucuuguugguuugaaaacaagggacugguggagugcaauaaccauuaccuuugucugaauugccucacgcugcuucugagcgucuccaaccgguguccuauuugcaaaaugccccucccuaccaagcugcgccccucugcuguuccuacagccccgcccgcccaggugggcgauagaacccggccucccccuuauagccccuga

SEQ ID NO: 4374 - RNA, 300 nt, Artificial Sequence
  derived and/or modified CDS sequence (opt5) from Lassa virus__AAT49005__Z
augggcaacaagcaggccaaagcucccgagaccaaggacagcccuagagccucccugaucccggaugcgacacaccucgggccccaauucugcaaaucuuguugguuugaaaauaagggacugguggagugcaacaaucauuaccuuugucugaacugccucacgcugcuucugagcgucuccaaucgguguccuauuugcaaaaugccccucccuacccgccugagacccucugcuguuccuacagccccgcccgccccugcuggcgaccggaccaagcccccucccuauagcccguga

SEQ ID NO: 4375 - RNA, 300 nt, Artificial Sequence
  derived and/or modified CDS sequence (opt5) from Lassa virus__ADU56612__Z
augggcaacagacagacccggcccacagaggccacggaacaaagccgcgcccaccuggugccugacgccucccaucucgggccgcaguucugcaagucuuguugguuugagaauagaggacuggucgaaugcaacaaucacuaccuuugucugaacugccucagccugcuucuguccguuucuagccggugucccaucugcaaaaugccucuccccacccgccugaaggcguccgcucagccuucugcucccccuacagaggccccgcagaauaccacacccccucccuauaccccuuga

SEQ ID NO: 4376 - RNA, 300 nt, Artificial Sequence
  derived and/or modified CDS sequence (opt5) from Lassa virus__ADU56616__Z
augggcgggaagcacaccaaacagcccagagagagcaacuccccucgggccucucugaucccggacgcuacacaucucggaccccaauucugcaagagcuguugguuugaaaauaaaggccugguggagugcaacaaucacuaccuuugucugaacugccucucccugcuucugucugucagcaaucgcuguccuauuugcaagaugccccucccuacgagacugcggaccuccacaaaccccaccgccccucagguugaacagacagggccggcgucucccccucccuauagcccuuga

SEQ ID NO: 4377 - RNA, 300 nt, Artificial Sequence
  derived and/or modified CDS sequence (opt5) from Lassa virus__ADU56620__Z
augggcgggaagcacaccaaaccccagagagagagcaacuccccucgggccucucugaucccggacgcuacacaucucggaccccaauucugcaagagcuguugguuugaaaauaaaggccugguggagugcaacaaucacuaccuuugucugaacugccucacgcugcuucuguccgucucuaaucgcuguccuauuugcaagaugccccucccuaccagacugcgggccagcacaaaccccaccgcgccucagguugaacagguggggccgacaaaucccccucccuauuccccuuga

SEQ ID NO: 4378 - RNA, 300 nt, Artificial Sequence
  derived and/or modified CDS sequence (opt5) from Lassa virus__ADU56624__Z
augggcaacagacacgccaagagcaccaaaguggacgagcaucagcgggcucaccugguccccgaugccucccaucucgggccucaauucugcaagucuuguugguuugaaaaucgcggacugguugagugcaacaaucacuaccuuugucugaacugccucagccugcuucuguccgugucuagcagauguccgaucugcaaaaugccccucccuacaaagcugaaagcggcugcccagcccuccgccccuucuacggaagcuauucagaauaccacacccccuccguauacccccuga

SEQ ID NO: 4379 - RNA, 300 nt, Artificial Sequence
  derived and/or modified CDS sequence (opt5) from Lassa virus__ADU56628__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcugcccagcccuccgccccuucuacggaagcuauucagaauaccacacccccuccguaugcccccuga

SEQ ID NO: 4380 - RNA, 300 nt, Artificial Sequence
  derived and/or modified CDS sequence (opt5) from Lassa virus__ADU56632__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcugcccagcccuccgccccuucuacggaagcuacccaggacacaacacccccuccguauacccccuga

SEQ ID NO: 4381 - RNA, 300 nt, Artificial Sequence
  derived and/or modified CDS sequence (opt5) from Lassa virus__ADU56644__Z
augggcaacagacagaccaaggcccccgaggcuaaagggagcccucgggccucccugaucccggacgcgacacaccucggaccccaauucugcaagucuuguugguuugaaaauaaaggccugguggagugcaacgaucauuaccuuugucugaauugccucacgcugcuucugagcgucuccucucgcuguccuauuugcaagaugccccucccuaccagacugcggcccagcacaaacccuaccgcuccgcccgcccgcgccgaagggggaaucaauccucccccuuauucccccuga

SEQ ID NO: 4382 - RNA, 300 nt, Artificial Sequence
  derived and/or modified CDS sequence (opt5) from Lassa virus__AHC95545__Z
augggcaacaagcaggccaaagaccccaagaccgagagcuccccuagagcuucucugaucccggaugccacacaccucgggccccaauucugcaaaagcuguugguuugaaaacaagggacugguggagugcaacaaucauuaccuuugucugaacugccucucccugcuucugucugucagcaaucgguguccuauuugcaaaaugccccucccuacgaagcugaagcccaucaccacaccuaccgcgccgcagauuacacgcgaauccaucaccaaucccccucccuauacaccuuga

SEQ ID NO: 4383 - RNA, 300 nt, Artificial Sequence
  derived and/or modified CDS sequence (opt5) from Lassa virus__AHC95547__Z
augggcaacagacaggccaaggaccccaaaguggagagcuccccucgggcuucucugaucccggaugccacccaccucgggccccaauucugcaagagcuguugguuugaaaacaaaggacuggucgagugcaacaaucauuaccuuugucugaacugccucucccugcuucugucuguuagcaaucgcuguccuauuugcaagaugccccucccuacaagacugcggcccacgaccaugccuacagcgccgcagaucauuaaagaaggcaccacaaaucccccucccuauaccccuuga

SEQ ID NO: 4384 - RNA, 300 nt, Artificial Sequence
  derived and/or modified CDS sequence (opt5) from Lassa virus__AIT17124__Z
augggcaacaaacaggugaagacccccgaggccaaggacagcccuagagcuucccugaucccggaugccacacaccucgggccccaauucugcaaaucuuguugguuugaaaauaagggacuggucgagugcaacaaucauuaccuuugucugaacugccucacgcugcuucugagcguuggcaaucgguguccuauuugcaaaaugccccucccuaccaagcugcgccccuccgugacaccuaccgcgccgcccacaagagcugccgacucuaucgggccucccccuuauagccccuga

SEQ ID NO: 4385 - RNA, 300 nt, Artificial Sequence
  derived and/or modified CDS sequence (opt5) from Lassa virus__AIT17128__Z
augggcaacaagcaggccaaaacccccgaggcuaaggacagcccuagagccaaucugaucccggaugcgacacaccucgggccccaauucugcaaauccuguugguuugaaaacaagggacugguggagugcaauaaccauuaccuuugucugaauugccucacgcugcuucugucugucagcaaccgguguccuauuugcaaaaugccccucccuaccaagcugcgccccuccgcugccccuacagccccgcccaccggcgcugccgacucuaucagaccucccccuuauagccccuga

SEQ ID NO: 4386 - RNA, 300 nt, Artificial Sequence
  derived and/or modified CDS sequence (opt5) from Lassa virus__AIT17132__Z
augggcaacaagcaggccaaagcucccgaggccagagacagcccucgggcgucccugaucccggaugcuacccaccucgggccccaauucugcaagucuuguugguuugaaaauaaaggacugguggagugcaacaaucauuaccuuugucugaacugccucacacugcuucugagcgucuccaaucgcuguccuauuugcaagaugccccucccuacgaaacugagacccucugccaccccuacagccccgcccaccgaagcugccgacagcauccggccucccccuuaucgccccuga

SEQ ID NO: 4387 - RNA, 300 nt, Artificial Sequence
  derived and/or modified CDS sequence (opt5) from Lassa virus__AIT17136__Z
augggcaacaagcagaccaaagcccccgagagcaaaaauuccccuagagcuucucugaucccggacgccacauaccucgggccccaauucugcaagagcuguugguuugaaaacaagggacugguggagugcaauaaccacuaucuuugucugaauugccucacgcugcuucuguccgucucuaaccgguguccuauuugcaaaaugccccucccuaccaagcugcgcagcuccgcggcucccacagccccuccgaccggcgccgcugauucuacaaagcccccucccuacagcccuuga

SEQ ID NO: 4388 - RNA, 300 nt, Artificial Sequence
  derived and/or modified CDS sequence (opt5) from Lassa virus__AIT17140__Z
augggcaacaagcaggccaaagcucccgagccuaaggacagcccgagagccucccugauccccgaugcgacccaccucgggccucaauucugcaaaucuuguugguuugaaaauaagggacugguggagugcaacaaucauuaccuuugucugaacugccucacacugcuucugagcgucuccaaucggugucccauuugcaaaaugccucuccccacgaagcugcgcccuucugcugccccgaccgcucccccugccggcgccguugacagcacaagacccccucccuauuccccguga

SEQ ID NO: 4389 - RNA, 300 nt, Artificial Sequence
  derived and/or modified CDS sequence (opt5) from Lassa virus__AIT17144__Z
augggcaacaagcaggccaaaacccccgagagcaaggacuccccuagagcuucucugaucccggaugccacacaccucgggccccaauucugcaaaagcuguugguuugaaaauaagggacugguggagugcaacaaucauuaccuuugucugaacugccucacgcugcuucugggcgucuccaaucgguguccuauuugcaaaaugccccucccuaccaagcugcgcucuagcguugcgcccacagcuccuccgaccggggccguggacuccaucagacccccucccuauucuccuuga

SEQ ID NO: 4390 - RNA, 300 nt, Artificial Sequence
  derived and/or modified CDS sequence (opt5) from Lassa virus__AIT17152__Z
augggcaacaagcaggccaaaacccccgagacaaaggacagcccuagagcuucccugaucccggaugccacgcaccucgggccccaauucugcaaaucuuguugguuugaaaauaagggacugguggagugcaacaaucauuaccuuugucugaacugccucacccugcuucugagcgucuccaaucgguguccuauuugcaaaaugccccucccuacaaagcugcgccccucuaccgcgccuacagcuccgcccgccggcgccgcugacaacaccagaccucccccuuauagccccuga

SEQ ID NO: 4391 - RNA, 300 nt, Artificial Sequence
  derived and/or modified CDS sequence (opt5) from Lassa virus__AIT17162__Z
augggcaacaagcaggccaaagcuagcgaguccaaggacucucccagagccagccugaucccugaugcgacccaccucgggccgcaauucugcaaauccuguugguuugaaaauaagggacugguggagugcaacaaucauuaccuuugucugaacugccucacacugcuucugucugucagcaaucggugucccauuugcaaaaugccucuccccacgaagcugcgcccuuccguuacccccacagcuccuccgaccagaacagccgacaacacccggcccccucccuauucuccuuga

SEQ ID NO: 4392 - RNA, 300 nt, Artificial Sequence
  derived and/or modified CDS sequence (opt5) from Lassa virus__AIT17166__Z
augggcaacaagcaggccaaagcucccgaggccaaggacagcccuagagcgucccugaucccggaugcuacccaccucgggccccaauucugcaaaucuuguugguuugaaacaaagggacugguggagugcaauaaccauuaccuuugucugaauugccucacgcugcuucugagcgucuccaaccgguguccuauuugcaaaaugccccucccuaccaagcugcgccccucugccacaccuaccgccccgcccacagaagcugccgacagcaucggcccucccccuuauucccccuga

SEQ ID NO: 4393 - RNA, 300 nt, Artificial Sequence
  derived and/or modified CDS sequence (opt5) from Lassa virus__AIT17170__Z
augggcaacaagcaggccaaagugcccgagagcaaggacuccccuagagcuucucugaucccggaugccacccaccucgggccccaauucugcaaaagcuguugguuugaaaauaagggacuggucgagugcaacaaucauuaccuuugucugaacugccucacacugcuucuguccguuucuaaucgguguccuauuugcaaaaugccccucccuacgaagcugcgccccagcgcggcuccuaccgccccgcccgccggcgcugccgacuccaucagaccucccccuuauucucccuga

SEQ ID NO: 4394 - RNA, 300 nt, Artificial Sequence
  derived and/or modified CDS sequence (opt5) from Lassa virus__AIT17174__Z
augggcaacaagcagaccaaagcccccgaggcuaaggggagcccuagagccucccugaucccggacgcgacacaccucggaccccaauucugcaaaucuuguugguuugaaaauaagggccugguggagugcaacaaucauuaccuuugucugaacugccucacgcugcuucugagcgucuccucucgguguccuauuugcaaaaugccccucccuaccaagcugcgccccagcgcuguuccuacagccccgcccaccaaggccgaagauaauacaagaccucccccuuauucccccuga

SEQ ID NO: 4395 - RNA, 300 nt, Artificial Sequence
  derived and/or modified CDS sequence (opt5) from Lassa virus__AIT17178__Z
augggcaacaagcaggccaaagcuagcgaggccaaggacucccccagagcgucucugaucccugaugcuacccaccucgggccgcaauucugcaaaagcuguugguuugaaaauaagggacugguggagugcaacaaucauuaccuuugucugaacugccucucccugcuucugucugucagcucccggugucccauuugcaaaaugccucuccccacacgccugagaccuucuacggcccccaccgccccuccggcucgggccggcgacaauaucaagcccccucccuauagcccuuga

SEQ ID NO: 4396 - RNA, 300 nt, Artificial Sequence
  derived and/or modified CDS sequence (opt5) from Lassa virus__AIT17182__Z
augggcaacaagcaggccaaagugcccgaggucagagacagcccucgggcuucccugaucccggaugccacccaccucgggccccaauucugcaagucuuguugguuugaaaauaaaggacugguugagugcaacaaucauuaccuuugucugaacugccucacacugcuucugagcguguccucucgcuguccuauuugcaagaugccccucccuacgaaacugagacccagcgcgaccccuacagcuccgcccgccggcgccggggacggaacccggccucccccuuauucccccuga

SEQ ID NO: 4397 - RNA, 300 nt, Artificial Sequence
  derived and/or modified CDS sequence (opt5) from Lassa virus__AIT17186__Z
augggcaacaagcaggccaaaacccccgagacaaaggacagcccuagagcuucccugaucccggaugccacgcaccucgggccccaauucugcaaaucuuguugguuugaaaauaagggacugguggagugcaacaaucauuaccuuugucugaacugccucacccugcuucugagcgucuccaaucgguguccuauuugcaaaaugccccucccuacaaagcugcgccccucuguugcgccuaccgcuccgcccgccggcgccgcugacaacacaagaccucccccuuauagccccuga

SEQ ID NO: 4398 - RNA, 300 nt, Artificial Sequence
  derived and/or modified CDS sequence (opt5) from Lassa virus__AIT17194__Z
augggcaacaagcaggccaaagcccccgagccuaaggacagcccgagagccucccugauccccgaugcgacccaccucgggccucaauucugcaaaucuuguugguuugaaaauaagggacugguggagugcaacaaucauuaccuuugucugaacugccucacacugcuucugagcgucuccaaucggugucccauuugcaaaaugccucuccccacgaagcugcgcccuucuguugcuccgaccgcucccccugccggcgugguggacagcacaagacccccucccuauuccccguga

SEQ ID NO: 4399 - RNA, 300 nt, Artificial Sequence
  derived and/or modified CDS sequence (opt5) from Lassa virus__AIT17198__Z
augggcaacaagcaggccaaagugcccgagagcaaggacuccccuagagcuucucugaucccggaugccacccaccucgggccccaauucugcaaaagcuguugguuugaaaaucggggacuggucgagugcaacaaucauuaccuuugucugaacugccucacacugcuucuguccguuucuaaucgcuguccuauuugcaagaugccccucccuacgaaacugagacccagcaccgcgccuacagcuccgcccaccggcgccgccgacuccacacggccucccccuuauucucccuga

SEQ ID NO: 4400 - RNA, 300 nt, Artificial Sequence
  derived and/or modified CDS sequence (opt5) from Lassa virus__AIT17202__Z
augggcaacaagcaggccaaaacccccgagagcaaggacuccccuagagcuucucugaucccggaugccacacaccucgggccccaauucugcaaaagcuguugguuugaaaauaagggacugguggagugcaacaaucauuaccuuugucugaacugccucacgcugcuucuguccgucucuaaucgguguccuauuugcaaaaugccccucccuacccgccugagacccagcgcggcuccuacagccccgcccuccggcgccgcugacucuacccggccucccccuuauagccccuga

SEQ ID NO: 4401 - RNA, 300 nt, Artificial Sequence
  derived and/or modified CDS sequence (opt5) from Lassa virus__AIT17206__Z
augggcaacaagcaggccaaagcucccgaggccaaggacagcccuagagcgucccugaucccggaugcuacccaccucgggccccaauucugcaaaucuuguugguuugaaaauaagggacugguggagugcaacaaucauuaccuuugucugaacugccucacacugcuucugagcgucuccuaucgguguccuauuugcaaaaugccccucccuacgaagcugcgccccucugccaccccuacagccccgcccaccgaagcugccgacagcaucagaccucccccuuaccggcccuga

SEQ ID NO: 4402 - RNA, 300 nt, Artificial Sequence
  derived and/or modified CDS sequence (opt5) from Lassa virus__AIT17214__Z
augggcaacaagcaggccaaagcucccgaggugaaggacagcccuagagccucccugaucccggaugcgacccaccucgggccccaauucugcaaaucuuguugguuugaaaauaagggacuggucgagugcaacaaucauuaccuuugucugaacugccucacacugcuucugagcguuuccaaucgguguccuauuugcaaaaugccccucccuacgaagcugcgccccucugcugccccuaccgccccgcccacaggcaccgcugacagcaucagaccucccccuuauucccccuga

SEQ ID NO: 4403 - RNA, 300 nt, Artificial Sequence
  derived and/or modified CDS sequence (opt5) from Lassa virus__AIT17222__Z
augggcaacaagcaggccaaaacccccgagacaaaggacagcccuagagcuucccugaucccggaugccacgcaccucgggccccaauucugcaaaucuuguugguuugaaaauaagggacugguggagugcaacagccauuaccuuugucugaauugccucacccugcuucuguccgucucuagccgguguccuauuugcaaaaugccccucccuacacgccugagacccuccaccgcgccuacagcuccgcccgccggcguuggggacucuaccagcccucccccuuauucccccuga

SEQ ID NO: 4404 - RNA, 300 nt, Artificial Sequence
  derived and/or modified CDS sequence (opt5) from Lassa virus__AIT17226__Z
augggcaacaagcaggccaaaacccccgaggcuaaggacagcccuagagccucccugaucccggaugcgacacaccucgggccccaauucugcaaaucuuguugguuugaaaauaagggacugguggagugcaacaaucauuaccuuugucugaacugccucacgcugcuucugagcgucuccaaucgguguccuauuugcaaaaugccccucccuaccaagcugcgccccucugcuacaccuaccgccccgcccgccggcgcugccgacagcaucgggccucccccuuauucccccuga

SEQ ID NO: 4405 - RNA, 297 nt, Artificial Sequence
  derived and/or modified CDS sequence (opt5) from Lassa virus__AIT17230__Z
augggcaacaagcaggccaaagcuagcgacaaaaauucccccagagccucucugaucccugaugcgacccaccucgggccgcaauucugcaagagcuguugguuugagaacaagggacugguggaaugcaauaaccauuaccuuugucugaauugccucacacugcuucuguccgucucuaaccggugucccauuugcaaaaugccucuccccacgaagcugcgcccuagcgcuacccccacagccccuccgaccggcgccgcugacuccaucagacccccucccuauucuccuuga

SEQ ID NO: 4406 - RNA, 300 nt, Artificial Sequence
  derived and/or modified CDS sequence (opt5) from Lassa virus__AIT17234__Z
augggcaacaagcaggccaaagcuagcgaggaaaagaacucccccagagccucucugaucccugacgcgacccaccucgggccgcaauucugcaaaagcuguugguuugagaauaagggacugguggaaugcaauaaccauuaccuuugucugaauugccucacacugcuucuguccgucucuaaccggugucccauuugcaaaaugccucuccccacgaagcugcgcccuagcgcuacccccacagccccuccgaccggcgccgcugauuccaucagacccccucccuauucuccuuga

SEQ ID NO: 4407 - RNA, 300 nt, Artificial Sequence
  derived and/or modified CDS sequence (opt5) from Lassa virus__AIT17238__Z
augggcaacaagcagaccaaagcccccgaggcuaaggggagcccuagagccucccugaucccggacgcgacacaccucggaccccaauucugcaaaucuuguugguuugaaaauaagggccugguggagugcaacaaucauuaccuuugucugaacugccucacgcugcuucugagcgucuccaaucgguguccuauuugcaaaaugccccucccuaccaagcugcgccccucugcuacaccuaccgccccgcccacagaagccgcugauagcaucagaccucccccuuaucggcccuga

SEQ ID NO: 4408 - RNA, 300 nt, Artificial Sequence
  derived and/or modified CDS sequence (opt5) from Lassa virus__AIT17242__Z
augggcaacaagcaggccaaagcucccgagagcaaggacuccccuagagccucucugaucccggaugcgacccaccucgggccccaauucugcaaaagcuguugguuugaaaauaagggacugguggagugcaacaaucauuaccuuugucugaacugccucacacugcuucuguccgucucuaaucgguguccuauuugcaaaaugccccucccuacgcgccugagacccagcgcugccccuaccgccccgcccacaggcgcuaccgacuccacacggccucccccuuauucucccuga

SEQ ID NO: 4409 - RNA, 300 nt, Artificial Sequence
  derived and/or modified CDS sequence (opt5) from Lassa virus__AIT17248__Z
augggcaacaaacaggugaaggcccccgaggcuagaaauagcccucgggccucccugaucccggacgcgacccaccucgggccccaauucugcaagucuuguugguuugaaaacaaaggacuggucgagugcaauaaccauuaccuuugucugaauugccucacacugcuucugggcguuagcucccgcuguccuauuugcaagacgccccucccuaccagacugcggcccucugcuacaccuaccgccccgcccgccggggcuggagauaacacacgcccucccccuuauagccccuga

SEQ ID NO: 4410 - RNA, 300 nt, Artificial Sequence
  derived and/or modified CDS sequence (opt5) from Lassa virus__AIT17252__Z
augggcaacaagcaggccaaagcucccgaggccaaggacagcccuagagcgucccugaucccggaugcuacccaccucgggccccaauucugcaaaucuuguugguuugaaaauaagggacugguggagugcaacaaucauuaccuuugucugaacugccucacacugcuucugagcgucuccaaucgguguccuauuugcaaaaugccccucccuacgaagcugcgccccucuaccgccccuacagccccgcccgcuggcgccgcugacagcaccagaccucccccuuauucccccuga

SEQ ID NO: 4411 - RNA, 300 nt, Artificial Sequence
  derived and/or modified CDS sequence (opt5) from Lassa virus__AIT17256__Z
augggcaacaagcaggccaaagcucccgagaccaaggacagcccuagagccucccugaucccggaugcgacacaccucgggccccaauucugcaaaucuuguugguuugaaaauaagggacugguggagugcaacaaucauuaccuuugucugaacugccucacgcugcuucugagcgucuccaaucgguguccuauuugcaaaaugccccucccuaccaagcugcgccccucugcugccccuacagccccgcccguuggcgcugccgacaacaccagaccucccccuuauagccccuga

SEQ ID NO: 4412 - RNA, 300 nt, Artificial Sequence
  derived and/or modified CDS sequence (opt5) from Lassa virus__AIT17260__Z
augggcaacaagcaggccaaagcucccgagcugaaggacagcccuagagccucccucaucccggaugcgacccaccuggggccccaauucugcaaaucuuguugguuugaaaauaagggacuuguggagugcaacaaucauuaccugugucucaacugccugacacuucugcucagcgucuccaaucgguguccuauuugcaaaaugccccugccuacgaagcugcgccccucugcugccccuaccgccccgcccgcuggcgccguugacagcacaagaccucccccuuauucccccuga

SEQ ID NO: 4413 - RNA, 300 nt, Artificial Sequence
  derived and/or modified CDS sequence (opt5) from Lassa virus__AIT17268__Z
augggcaacaagcagaccaaagcccccgaggugaaggggagcccuagagcuucccugaucccggacgccacacaccucggaccccaauucugcaaaucuuguugguuugaaaauaagggccuggucgagugcaacaaucauuaccuuugucugaacugccucacgcugcuucugagcguuuccaaucgguguccuauuugcaaaaugccccucccuaccaagcugaagcccucuacaaccccuacagcgccgcccaccggggcugccgauagcauccgcccucccccuuauucccccuga

SEQ ID NO: 4414 - RNA, 300 nt, Artificial Sequence
  derived and/or modified CDS sequence (opt5) from Lassa virus__AIT17272__Z
augggcaacaaacaggugaagaccagcgaggcccgcgacucuccccgggcuucccugaucccugaugccacagaccucgggccgcaauucugcaagagcuguugguuugaaaauaaaggacuggucgagugcaacaaucacuaccuuugucugaacugccucacgcugcuucuguccguuucuaaucgcugucccauuugcaagaugccucuccccaccagacugcggccuagcgcgaaccccacagcuccuccggccgaaaccggcgauuccacaagacccccucccuauucuccuuga

SEQ ID NO: 4415 - RNA, 300 nt, Artificial Sequence
  derived and/or modified CDS sequence (opt5) from Lassa virus__AIT17278__Z
augggcagcaagcagaccaaaacacccgaggugaaggacuccccuagagccucucugaucccggaugcuacgcaccucgggccccaauucugcaaaagcuguugguuugaaaacaagggacuggucgagugcaauaaccauuaccuuugucugaauugccucacccugcuucuguccguuucuaaccgguguccuauuugcaaaaugccccucccuacaaagcugcgccccagcgccgcgccuaccgcuccgcccgccagagccgcugacgauacacggccucccccuuauucccccuga

SEQ ID NO: 4416 - RNA, 300 nt, Artificial Sequence
  derived and/or modified CDS sequence (opt5) from Lassa virus__AIT17282__Z
augggcaacaagcaggccaaagcucccgagccuaaggacagcccgagagccucccugauccccgaugcgacccaccucgggccucaauucugcaaaucuuguugguuugaaaauaagggacugguggagugcaacaaucauuaccuuugucugaacugccucacacugcuucugagcgucuccaaucggugucccauuugcaaaaugccucuccccacgaagcugcgcccuucugcugccccgaccgcucccccugccggcgccguugacagcaucagacccccucccuauuccccguga

SEQ ID NO: 4417 - RNA, 300 nt, Artificial Sequence
  derived and/or modified CDS sequence (opt5) from Lassa virus__AIT17286__Z
augggcaacaagcagaccaaagcccccgaggugaaggacagcccuagagcuucccugaucccggaugccacacaccucgggccccaauucugcaaaucuuguugguuugaaaauaagggacuggucgagugcaacaaucauuaccuuugucugaacugccucacgcugcuucugagcguuuccaaucgguguccuauuugcaaaaugccccucccuaccaagcugcgccccucuacagcgccuaccgcuccgcccgccggcacaauggacagcaccagaccucccccuuauucccccuga

SEQ ID NO: 4418 - RNA, 300 nt, Artificial Sequence
  derived and/or modified CDS sequence (opt5) from Lassa virus__AIT17290__Z
augggcaacaagcaggccagagcucccgaggccaaagacagcccucgggcgucccugaucccggaugcuacccaccucgggccccaauucugcaagucuuguugguuugaaaauaaaggacugguggagugcaacaaucauuaccuuugucugaacugccucacacugcuucugagcgucuccucucgcuguccuauuugcaagaugccccucccuacgagacugcggcccagcgccaucccuaccgccccgcccgcuggcacaggggacuccucucgcccucccccuuauagccccuga

SEQ ID NO: 4419 - RNA, 300 nt, Artificial Sequence
  derived and/or modified CDS sequence (opt5) from Lassa virus__AIT17296__Z
augggcaacaagcaggccaaaacccccgagaucaaggacagcccuagagcuucccugauuccggaugccacacaccucgggccccaauucugcaaaucuuguugguuugaaaauaagggacugguggagugcaacaaucauuaccuuugucugaacugccucacgcugcuucugagcgucuccaaucgguguccuaucugcaaaaugccccucccuaccaagcugcgccccucugcggcuccuacagccccgcccgccggcgcugccgacauuaccagaccucccccuuauagccccuga

SEQ ID NO: 4420 - RNA, 300 nt, Artificial Sequence
  derived and/or modified CDS sequence (opt5) from Lassa virus__AIT17300__Z
augggcaacaaacaggugaaggcccccgaggcuagaaauagcccucgggccucccugaucccggacgcgacccaccucgggccccaauucugcaagucuuguugguuugaaaacaaaggacuggucgagugcaauaaccauuaccuuugucugaauugccucacacugcuucugggcguuagcucccgcuguccuauuugcaagaugccccucccuacgagacugcggcccucuaccgcuccuacagccccgcccgccggggcuggagauaacacccgcccucccccuuauagccccuga

SEQ ID NO: 4421 - RNA, 300 nt, Artificial Sequence
  derived and/or modified CDS sequence (opt5) from Lassa virus__AIT17312__Z
augggcaacaagcaggccaaaacccccgagacaaaggacagcccuagagcuucccugaucccggaugccacgcaccucgggccccaauucugcaaaucuuguugguuugaaaauaagggacugguggagugcaacaaucauuaccuuugucugaacugccucacccugcuucugagcgucuccaaucgguguccuauuugcaaaaugccccucccuacaaagcugcgccccucugcggcuccuaccgccccgcccguuggcgccgcugacagcacaagaccucccccuuauucccccuga

SEQ ID NO: 4422 - RNA, 300 nt, Artificial Sequence
  derived and/or modified CDS sequence (opt5) from Lassa virus__AIT17316__Z
augggcaacaagcaggccaaagcucccgaggccagaaauagcccucgggcgucccugaucccggacgcuacccaccucgggccccaauucugcaagucuuguugguuugaaaaccgcggacugguggagugcaauaaccauuaccuuugucugaauugccucacacugcuucugagcgucuccucuagauguccuauuugcaaaaugccccucccuacgcggcugcgccccagcgccgccccuaccgcuccgcccgccggcgcuggggauaacacaagaccucccccuuauucccccuga

SEQ ID NO: 4423 - RNA, 300 nt, Artificial Sequence
  derived and/or modified CDS sequence (opt5) from Lassa virus__AIT17320__Z
augggcaacaagcaggccaaagcucccgaggcccgcaauagcccucgggcgucccugaucccggacgcuacccaccucgggccccaauucugcaagucuuguugguuugaaaacaaaggacugguggagugcaauaaccauuaccuuugucugaauugccucacacugcuucugggcgucagcucccgcuguccuauuugcaagaugccccucccuacgagacugcggcccucugccgccccuaccgcuccgcuggccgaagcuggggauaacacaagacccccucccuauagcccuuga

SEQ ID NO: 4424 - RNA, 300 nt, Artificial Sequence
  derived and/or modified CDS sequence (opt5) from Lassa virus__AIT17326__Z
augggcaacaagcagagcaaagcccccgaguccagagacucuccucgggcuagccugaucccggaugccacccaccucgggccccaauucugcaaguccuguugguuugaaaauaaaggacugguggagugcaacaaucauuaccuuugucugaacugccucacacugcuucugucugucagcaaucgcuguccuauuugcaagaugccccucccuacgaaacugagacccuccgcgaccccuacagcuccgcccacccgggccgccgacucuauccgcccucccccuuauagccccuga

SEQ ID NO: 4425 - RNA, 300 nt, Artificial Sequence
  derived and/or modified CDS sequence (opt5) from Lassa virus__AIT17330__Z
augggcaacaagcaggccaaagcucuggagagcaaaaauucccccagagccucucucaucccugacgcgaccuaccuggggccgcaauucugcaagagcuguugguuugaaaacaagggacuuguggagugcaauaaccacuaucugugucucaauugccugacacuucugcucuccgucucuaaccggugucccauuugcaaaaugccucugcccacgaagcugcgcagcuccgcugccccuaccgcucccccuacaggcgccgccgaugggaccaagccgcccccuuacucucccuga

SEQ ID NO: 4426 - RNA, 300 nt, Artificial Sequence
  derived and/or modified CDS sequence (opt5) from Lassa virus__AIT17342__Z
augggcaacaagcaggccaaagcuagcgaggccaaggacucccccagagcgucucugaucccugaugcuacccaccucgggccgcaauucugcaaaagcuguugguuugaaaauaagggacugguggagugcaacaaucauuaccuuugucugaacugccucacacugcuucuguccgucucuaaucggugucccauuugcaaaaugccucuccccacgaagcugcgcccuagcaccgcccccacagccccucagaccggcgcugccgacuccaucagaccgcccccuuauucucccuga

SEQ ID NO: 4427 - RNA, 300 nt, Artificial Sequence
  derived and/or modified CDS sequence (opt5) from Lassa virus__AIT17346__Z
augggcaacaagcaggccaaagcucccgagaccaaggacagcccuagagccucccugaucccggaugcgacacaccucgggccccaauucugcaaaucuuguugguuugaaaauaagggacugguggagugcaacaaucauuaccuuugucugaacugccucacgcugcuucugagcgucuccaaucgguguccuauuugcaaaaugccccucccuaccaagcugcgccccucugcugccccuacagccccgcccguuggcgcugccgacagcaccagaccucccccuuauucccccuga

SEQ ID NO: 4428 - RNA, 300 nt, Artificial Sequence
  derived and/or modified CDS sequence (opt5) from Lassa virus__AIT17362__Z
augggcaacaagcaggccaaagcucccgagagcaaggacuccccuagagccucucugaucccggaugcgacccaccucgggccccaauucugcaaaagcuguugguuugaaaauaagggacugguggagugcaacaaucauuaccuuugucugaacugccucacacugcuucuguccgucucuaaucgguguccuauuugcaaaaugccccucccuacgaagcugcgccccagcgcugccccuaccgccccgcccgcuggcgccgcugacuccaucagaccucccccuuauucucccuga

SEQ ID NO: 4429 - RNA, 300 nt, Artificial Sequence
  derived and/or modified CDS sequence (opt5) from Lassa virus__AIT17366__Z
augggcaacaagcagaccaaaacacccgaggugaaggacagcccuagagccucccugaucccggaugcuacgcaccucgggccccaauucugcaaaucuuguugguuugaaaauaagggacuggucgagugcaacaaucauuaccuuugucugaacugccucacccugcuucugagcguuuccaaucgguguccuauuugcaaaaugccccucccuacaaagcugcgccccucugccgcgccuaccgcuccgcccgccagagccgcugacgauacacggccucccccuuauagccccuga

SEQ ID NO: 4430 - RNA, 300 nt, Artificial Sequence
  derived and/or modified CDS sequence (opt5) from Lassa virus__AIT17376__Z
augggcaacaagcaggccaaagcucccgagagcaaggacuccccuagagccucucugaucccggaugcgaccuaccucgggccccaauucugcaaaagcuguugguuugaaaauaagggacugguggagugcaacaaucacuaucuuugucugaacugccucacacugcuucuguccgucucuaaucgguguccuauuugcaaaaugccccucccuacgaagcugcgcagcuccguugcucccaccgccccuccgacaagagccgcugacucuacccggcccccucccuacagcccuuga

SEQ ID NO: 4431 - RNA, 300 nt, Artificial Sequence
  derived and/or modified CDS sequence (opt5) from Lassa virus__AIT17382__Z
augggcaacaagcagaccaaaacaagcgaggugaaggacucccccagagccucucugaucccugaugcuacgcaccucgggccgcaauucugcaaaagcuguugguuugaaaauaagggacuggucgagugcaacaaucauuaccuuugucugaacugccucacccugcuucuguccguuucuaaucggugucccauuugcaaaaugccucuccccacaaagcugcgcccuagcgccgcgcccaccgcuccuccggccagagccgcugacgauacacggcccccucccuauuccccuuga

SEQ ID NO: 4432 - RNA, 300 nt, Artificial Sequence
  derived and/or modified CDS sequence (opt5) from Lassa virus__AIT17386__Z
augggcaacaagcaggccaaaacccccgaggcuagagacagcccucgggccucccugaucccggaugcgacacaccucgggccccaauucugcaagucuuguugguuugaaaauaaaggacugguggagugcaacaaucauuaccuuugucugaacugccucacgcugcuucugagcgucuccucucgcuguccuauuugcaagaugccccucccuaccaaacugagacccagcgcuacaccuaccgccccgcccgccggcgcuggggacggaacacggccucccccuuauucccccuga

SEQ ID NO: 4433 - RNA, 300 nt, Artificial Sequence
  derived and/or modified CDS sequence (opt5) from Lassa virus__AIT17396__Z
augggcaacaaacaggugaaggcccccgaggcuagaaauagcccucgggccucccugaucccggacgcgacccaccucgggccccaauucugcaagucuuguugguuugaaaacaaaggacuggucgagugcaauaaccauuaccuuugucugaauugccucacacugcuucugggcguuagcucccgcuguccuauuugcaagaugccccucccuacgagacugcggcccucugcugccccuaccgccccgcccgcugaagccggggauaacacacgcccucccccuuauagccccuga

SEQ ID NO: 4434 - RNA, 300 nt, Artificial Sequence
  derived and/or modified CDS sequence (opt5) from Lassa virus__AIT17402__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcugcccagcccuccgccccuucuacggaaaccauucagaauacaacacccccuccguauacccccuga

SEQ ID NO: 4435 - RNA, 300 nt, Artificial Sequence
  derived and/or modified CDS sequence (opt5) from Lassa virus__AIT17406__Z
augggcaacagacaggccaagagcuccaaaguggacgagcaccaacgggcucaucugguccccgaugccucucaccucgggccucaguucugcaagagcuguugguuugaaaauaaaggacugguugagugcaacaaucauuaccuuugucugaacugccucucccugcuucugucugugagcucccgcuguccgaucugcaagaugccccucccuaccaaacugaaggcggcugcccagcccucugccccuagcacagaagcugugcagaauacggcucccccuccguaugcccccuga

SEQ ID NO: 4436 - RNA, 300 nt, Artificial Sequence
  derived and/or modified CDS sequence (opt5) from Lassa virus__AIT17410__Z
augggcaacaagcaggccaaaagcaccaagguggacgagcaccaaagagcucaucugguccccgaugccucccaccucgggccucaguucugcaaaucuuguugguuugaaaaucggggacugguugagugcaacaaucauuaccuuugucugaacugccucagccugcuucuguccgugucuagccgcuguccgaucugcaagaugccccucccuacaagacugaaagcggcuacgcagcccuccgccccuucuaccgaagccacacagaauaccacacccccuccguauacccccuga

SEQ ID NO: 4437 - RNA, 300 nt, Artificial Sequence
  derived and/or modified CDS sequence (opt5) from Lassa virus__AIT17418__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcuacgcagcccuccgccccuucuaccgaaacaauucagaauaccacacccccuccguauacccccuga

SEQ ID NO: 4438 - RNA, 300 nt, Artificial Sequence
  derived and/or modified CDS sequence (opt5) from Lassa virus__AIT17422__Z
augggcaacagacaggccaagagcgcuaaaguggacgagcaccaacgggcccaucugguccccgaugcgucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuaccaagcugaaagcugccacacagcccuccgccccuucuacggaagcuacccagaauacaacacccccuccguauacccccuga

SEQ ID NO: 4439 - RNA, 300 nt, Artificial Sequence
  derived and/or modified CDS sequence (opt5) from Lassa virus__AIT17426__Z
augggcaacaagcaggccaaaagcaccaagguggacgagcaccaaagagcucaucugguccccgaugccucccaccucgggccucaguucugcaaaucuuguugguuugaaaaucggggacugguugagugcaacaaucauuaccuuugucugaacugccucagccugcuucuguccgugucuagccgcuguccgaucugcaagaugccccucccuacaaaacugaaggcggcuacgcagcccuccgccccuucuaccgaagccacacagaauaccacacccccuccguauacccccuga

SEQ ID NO: 4440 - RNA, 300 nt, Artificial Sequence
  derived and/or modified CDS sequence (opt5) from Lassa virus__AIT17432__Z
augggcaacaagcaggccaaaagcaccaagguggacgagcaccaaagagcucaucugguccccgaugccucccaccucgggccucaguucugcaaaucuuguugguuugaaaaucggggacugguugagugcaacaaucauuaccuuugucugaacugccucagccugcuucuguccgugucuagccgcuguccgaucugcaagaugccccucccuacaagacugaaagcggcuacgcagcccuccgccccuucuaccgaagccacacagaauaccauucccccuccguauacacccuga

SEQ ID NO: 4441 - RNA, 300 nt, Artificial Sequence
  derived and/or modified CDS sequence (opt5) from Lassa virus__AIT17436__Z
augggcaacaagcaggccaaaagcaccaaggcugacgagcaccaaagagcccaucuggugcccgaugcgucccaccucgggccucaguucugcaaaucuuguugguuugaaaaucggggacuggucgagugcaacaaucauuaccuuugucugaacugccucagccugcuucuguccguuucuagccgcuguccgaucugcaagaugccccucccuacaaaacugaaggcugccacgcagcccuccgccccuucuaccgaagcuacaagaaauaccacacccccuccguauacccccuga

SEQ ID NO: 4442 - RNA, 300 nt, Artificial Sequence
  derived and/or modified CDS sequence (opt5) from Lassa virus__AIT17444__Z
augggcaacagacaggccaagagcaccaaaguggacgagcaccaacgggcucaucugguccccgaugccucccaccucgggccucaguucugcaagucuuguugguuugaaaauaaaggacugguugagugcaacaaucauuaccuuugucugaacugccucagccugcuucuguccgugucuagccgcuguccgaucugcaagaugccccucccuacaaaacugaaggcggcugcccagcccuccgccccuucuacggaagcugcccagaauaccgcucccccuccguaugcccccuga

SEQ ID NO: 4443 - RNA, 300 nt, Artificial Sequence
  derived and/or modified CDS sequence (opt5) from Lassa virus__AIT17448__Z
augggcaacagacaggccaagagcaccaaagugggggagcaccaacgggcucaucugguccccgacgccucccaccucggaccucaguucugcaagucuuguugguuugaaaaucgcggccugguugagugcaacaaucauuaccuuugucugaacugccucagccugcuucuguccgugucuagcagauguccgaucugcaaaaugccccucccuacaaagcugaaagcgacggcucagcccuccgccccuucugccgaagcuauucagaauaccacacccccuccguauacccccuga

SEQ ID NO: 4444 - RNA, 300 nt, Artificial Sequence
  derived and/or modified CDS sequence (opt5) from Lassa virus__AIT17452__Z
augggcaacagacaggccaagagcacccggguggacgagcaccaacgcgcucaucugguccccgaugccucccaccucgggccucaguucugcaaaucuuguugguuugaaaauagaggacugguugagugcaacaaucauuaccuuugucugaacugccucagccugcuucuguccgugucuagccgguguccgaucugcaagaugccccucccuacacgccugagagcggcugugcagcccuccgccccuucuacggaaaccacacaggacaccacacccccuccguauagccccuga

SEQ ID NO: 4445 - RNA, 300 nt, Artificial Sequence
  derived and/or modified CDS sequence (opt5) from Lassa virus__AIT17456__Z
augggcaacagacaggccaagagcaccgaggucaaugaacaccaacgggcucaucugguccccgacgccucccaccucgggccucaguucugcaaaucuuguugguuugagaaccgcggacugguugaaugcaauaaccauuaccuuugucugaauugccucagccugcuucuguccgugucuagcagauguccgaucugcaagaugccccucccuacaaaacugaaggcggcuacgcagcccuccgccccuucuaccgaggugacacagaacaccgugcccccuccguauagccccuga

SEQ ID NO: 4446 - RNA, 300 nt, Artificial Sequence
  derived and/or modified CDS sequence (opt5) from Lassa virus__AIT17460__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcugcccagcccuccgccccucccacggaagcuacccagaauacaaccccuccgcccuauacaccuuga

SEQ ID NO: 4447 - RNA, 300 nt, Artificial Sequence
  derived and/or modified CDS sequence (opt5) from Lassa virus__AIT17468__Z
augggcaacagacaggccaagcaaaccaaaguggacgagcaccagcgggcucaucugguccccgaugccagccaccucgggccucaguucugcaaguccuguugguuugaaaaucgcggacugguugagugcaacaaucauuaccuuugucugaacugccucucucugcuucugagcaucuccucuagauguccgauuugcaaaaugccccucccuacaaagcugaaagcggcugcccagcccagcgccccuuccacggaagcuacccaagacacaacacccccuccguauacccccuga

SEQ ID NO: 4448 - RNA, 300 nt, Artificial Sequence
  derived and/or modified CDS sequence (opt5) from Lassa virus__AIT17472__Z
augggcaacaagcagaccaaaagcacaaaggccgacgagcaccaaagagcucaucuggugcccgaugccucccaccucgggccucaguucugcaaaucuuguugguuugaaaaucggggacuggucgagugcaacaaucauuaccuuugucugaacugccucagccugcuucuguccguuucuagccgcuguccgaucugcaagaugccccucccuacgagacugaaagcggcugcccagcccuccgccccuucuaccgaagcuacacaggacaccacacccccuccguauacccccuga

SEQ ID NO: 4449 - RNA, 300 nt, Artificial Sequence
  derived and/or modified CDS sequence (opt5) from Lassa virus__AIT17476__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcugcccagcccuccgccccuucugcugaagccauucagaauacgacacccccuccguauacccccuga

SEQ ID NO: 4450 - RNA, 300 nt, Artificial Sequence
  derived and/or modified CDS sequence (opt5) from Lassa virus__AIT17480__Z
augggcaacagacacgccaagagcaccaaaguggacgagcaucagcgggcucaccugguccccgaugccucccaucucgggccucaauucugcaagucuuguugguuugaaaaucgcggacugguugagugcaacaaucacuaccuuugucugaacugccucagccugcuucuguccgugucuagcagauguccgaucugcaaaaugccccucccuacaaagcugaaagcggcugcccagcccuccgccccuucuacggaagugauucagagcaccacacccccuccguauacccccuga

SEQ ID NO: 4451 - RNA, 300 nt, Artificial Sequence
  derived and/or modified CDS sequence (opt5) from Lassa virus__AIT17484__Z
augggcaacagacacgccaagagcaccaaaguggacgagcaucagcgggcucaccugguccccgaugccucccaucucgggccucaauucugcaagucuuguugguuugaaaaucgcggacugguugagugcaacaaucacuaccuuugucugaacugccucagccugcuucuguccgugucuagcagauguccgaucugcaaaaugccccucccuacaaagcugaaagcggcugcccagcccuccgccccuucuacggaagagauucagaauaccacacccccuccguauacccccuga

SEQ ID NO: 4452 - RNA, 300 nt, Artificial Sequence
  derived and/or modified CDS sequence (opt5) from Lassa virus__AIT17488__Z
augggcaacagacaggccaagcccaccaaaguggacgagcaccaacgggcucaucuggucccugaugccagccaccucgggccgcaguucugcaaguccuguugguuugaaaauaaaggacugguugagugcaacaaucauuaccuuugucugaacugccucucucugcuucugagcguguccucucgcugucccaucugcaagaugccucuccccacaaaacugaaggcggcugcccagccuagcgcccccuccacggaagcugcccagaauaccgcuccuccgcccuaugccccuuga

SEQ ID NO: 4453 - RNA, 300 nt, Artificial Sequence
  derived and/or modified CDS sequence (opt5) from Lassa virus__AIT17496__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacacggcugaaggcggcuacgcagcccuccgccccuucuaccgaagccacacagaccacaacacccccuccguauacccccuga

SEQ ID NO: 4454 - RNA, 300 nt, Artificial Sequence
  derived and/or modified CDS sequence (opt5) from Lassa virus__AIT17500__Z
augggcaacagacagaccaagagcacaaaaguggacgagcaccaacgggcccaucugguccccgaugcuucccaccucgggccucaguucugcaagucuuguugguuugaaaauaaaggacugguugagugcaacaaucauuaccuuugucugaacugccucagccugcuucuguccgugucuagccgcuguccgaucugcaagaugccccucccuacgaaacugaagaccgccgcgcagcccuccgcuccucccacagaagccgccagaaccacagcuccuccgcccuaugccccuuga

SEQ ID NO: 4455 - RNA, 300 nt, Artificial Sequence
  derived and/or modified CDS sequence (opt5) from Lassa virus__AIT17508__Z
augggcaacagacagaccaagagcacaaaaguggacgagcaccaacgggcccaucugguccccgaugcuucccaccucgggccucaguucugcaagucuuguugguuugaaaauaaaggacugguugagugcaacaaucauuaccuuugucugaacugccucagccugcuucuguccgugucuagccgcuguccgaucugcaagaugccccucccuacgaaacugaaggccgcggcucagcccuccgccccuucuaccgaagccacacagaauaccgcucccccuccguaugcccccuga

SEQ ID NO: 4456 - RNA, 300 nt, Artificial Sequence
  derived and/or modified CDS sequence (opt5) from Lassa virus__AIT17512__Z
augggcaacagacaggccaagagcaccaaaguguacgagcaccaacgggcucaucugguccccgacgccucccaccucgggccucaguucugcaagucuuguugguuugaaaaucgcggacugguugagugcaacaaucauuaucuuugucugaacugccucagccugcuucuguccgugucuagcagauguccgaucugcaaaaugccccucccuacacggcugaaggcggcuacgcagcccuccgccccuucuaccgaagccacacagaauaccacacccccuccguacacccccuga

SEQ ID NO: 4457 - RNA, 300 nt, Artificial Sequence
  derived and/or modified CDS sequence (opt5) from Lassa virus__AIT17516__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaaacggcgacccagcccuccgcuccucugacagaagccacccagaauacaacacccccuccguauacccccuga

SEQ ID NO: 4458 - RNA, 300 nt, Artificial Sequence
  derived and/or modified CDS sequence (opt5) from Lassa virus__AIT17520__Z
augggcaacaagcaggccaaaagcaccaagguggacgagcaccaaagagcucaucugguccccgaugccucccaccucgggccucaguucugcaaaucuuguugguuugaaaaucggggacugguugagugcaacaaucauuaccuuugucugaacugccucagccugcuucuguccgugucuaaucgcuguccgaucugcaagaugccccucccuacaaaacugaaggcggcugcccagcccagcgccccuuccacggaagcuacccagaacacaacacccccuccguauacccccuga

SEQ ID NO: 4459 - RNA, 300 nt, Artificial Sequence
  derived and/or modified CDS sequence (opt5) from Lassa virus__AIT17526__Z
augggcaacagacaggccaagagcgccaaagugaccgagcaccaacgggcccaucugguccccgacgcgucccaccucgggccucaguucugcaagucuuguugguuugaaaauaaaggacugguugagugcaacaaucauuaccuuugucugaacugccucagccugcuucuguccgugucuagccgcuguccgaucugcaagaugccccucccuacaagacugaaagcugccacgcagcccuccgccccuucugcugaagcuccccagagcaccacaccuccgcccuauaccccuuga

SEQ ID NO: 4460 - RNA, 300 nt, Artificial Sequence
  derived and/or modified CDS sequence (opt5) from Lassa virus__AIT17536__Z
augggcaacagacagacccggcccacagaggccacggaacaaagccgcgcucaccuggugccugacgccucccaucucgggccgcaguucugcaagucuuguugguuugagaauaaaggacuggucgaaugcaacaaucacuaccuuugucugaacugccucagccugcuucuguccguuucuagcagaugucccaucugcaagaugccucuccccacccggcugaaagcguccgcucagccuucugccccucccacagaggccccgcagaauaaggcucccccucccuauaccccuuga

SEQ ID NO: 4461 - RNA, 300 nt, Artificial Sequence
  derived and/or modified CDS sequence (opt5) from Lassa virus__AIT17542__Z
augggcaacagacaggucaagagcaccaaaguggacgagcaccaacgggcccaucugauccccgaugcuucccaccucgggccucaguucugcaagucuuguugguuugaaaaucgcggacugguugagugcaacaaucauuaccuuugucugaacugccucagccugcuucuguccgugucuagcagauguccgauuugcaaaaugccccucccuacaaagcuggaagccgcggcucagcccuccgccccuucuacggaggccacccaggacacaacacccccuccguauacccccuga

SEQ ID NO: 4462 - RNA, 300 nt, Artificial Sequence
  derived and/or modified CDS sequence (opt5) from Lassa virus__AIT17546__Z
augggcaacaagcaggccaaaagcaccaagguggacgagcaccaaagagcucaucugguccccgaugccucccaccucgggccucaguucugcaaaucuuguugguuugaaaaucggggacugguugagugcaacaaucauuaccuuugucugaacugccucagccugcuucuguccgugucuagccgcuguccgaucugcaagaugccccucccuacaaaacugaaggcggcugcccagcccuccgccccuucuacggaaaccauucagaauacaacacccccuccguauacccccuga

SEQ ID NO: 4463 - RNA, 300 nt, Artificial Sequence
  derived and/or modified CDS sequence (opt5) from Lassa virus__AIT17550__Z
augggcaacagacaggccaagcaaaccaaaguggacgagcaccagcgggcucaucugguccccgaugccagccaccucgggccucaguucugcaaguccuguugguuugaaaaucgcggacugguugagugcaacaaucauuaccuuugucugaacugccucucucugcuucugagcguguccucuagauguccgaucugcaaaaugccccucccuacaaagcugaaagcggcugcccagcccagcgccccuuccacggaaauuacccaaaauacaacacccccuccguauacccccuga

SEQ ID NO: 4464 - RNA, 300 nt, Artificial Sequence
  derived and/or modified CDS sequence (opt5) from Lassa virus__AIT17554__Z
augggcaacagacaggccaagagcaccaaagcugacgagcaccaacgggcccaucuggugcccgaugcgucccaccucgggccucaguucugcaagucuuguugguuugaaaaucgcggacuggucgagugcaacaaucauuaccuuugucugaacugccucagccugcuucuguccguuucuaauagauguccgaucugcaaaaugccccucccuacacggcugaaggcugccgcccagcccagcgcuccuuccacggaagccacccaggacacaacacccccuccguauacccccuga

SEQ ID NO: 4465 - RNA, 300 nt, Artificial Sequence
  derived and/or modified CDS sequence (opt5) from Lassa virus__AIT17558__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacacggcugaaggcggcugcccagcccuccgccccuucuacggaagcuauucgcagcaccacacccccuccguauacccccuga

SEQ ID NO: 4466 - RNA, 300 nt, Artificial Sequence
  derived and/or modified CDS sequence (opt5) from Lassa virus__AIT17570__Z
augggcaacagacaggccaagagcgcuaaagugaaugagcaccaacgggcccaucugguccccgacgcgucccaccucgggccucaguucugcaagucuuguugguuugaaaaccgcggacugguugagugcaauaaccauuaccuuugucugaauugccucagccugcuucuguccgugucuagcagauguccgaucugcaaaaugccccucccuaccaagcugaaagcugccgcccagcccuccgcuccuucuacagaagccacgcagaacauuacacccccuccguauacccccuga

SEQ ID NO: 4467 - RNA, 300 nt, Artificial Sequence
  derived and/or modified CDS sequence (opt5) from Lassa virus__AIT17578__Z
augggcaacagacaggccaagagcaccaaaguggacgagcaccaacgggcucaucugguccccgaugccucccaccucgggccucaguucugcaagucuuguugguuugaaaauaaaggacugguugagugcaacaaucauuaccuuugucugaacugccucagccugcuucuguccgugucuagccgcuguccgaucugcaagaugccccucccuacaaaacugagagcggcugcccagcccuccgccccuucuacggaaagcgcucagaauaccgcucccccuccguaugcccccuga

SEQ ID NO: 4468 - RNA, 300 nt, Artificial Sequence
  derived and/or modified CDS sequence (opt5) from Lassa virus__AIT17586__Z
augggcaacaagcaggccaaaagcaccaagguggacgagcaccaaagagcucaucugguccccgaugccucccaccucgggccucaguucugcaaaucuuguugguuugaaaaucggggacugguugagugcaacaaucauuaccuuugucugaacugccucagccugcuucuguccgugucuagccgcuguccgaucugcaagaugccccucccuacaagacugaaagcggcugcccagcccuccgccccuucuacggaagugacccagaauacaacacccccuccguauacccccuga

SEQ ID NO: 4469 - RNA, 300 nt, Artificial Sequence
  derived and/or modified CDS sequence (opt5) from Lassa virus__AIT17590__Z
augggcaacagacaggccaagagcaccaaaguggacgagcaccaacgggcucaucugguccccgaugccucccaccucgggccucaguucugcaagucuuguugguuugaaaauaaaggacugguugagugcaacaaucauuaccuuugucugaacugccucagccugcuucuguccgugucuagccgcuguccgaucugcaagaugccccucccuacaaaacuggaagcgacgacccagcccuccgcuccuucuacagaggaaacccagagcacaacacccccuccguauacccccuga

SEQ ID NO: 4470 - RNA, 300 nt, Artificial Sequence
  derived and/or modified CDS sequence (opt5) from Lassa virus__AIT17602__Z
augggcaacaagcaggccaaaagcaccaagguggacgaguaccaaagagcucaccugguccccgaugccucccaucucgggccucaguucugcaaaucuuguugguuugaaaaucggggacugguugagugcaacaaucacuaucuuugucugaacugccucagccugcuucuguccgugucuaaucgcuguccgaucugcaagaugccccucccuacaagacugaaagcggcugcccagcccagcgccccucccacggaagcuacccagaacacaaccccuccgcccuacacaccuuga

SEQ ID NO: 4471 - RNA, 300 nt, Artificial Sequence
  derived and/or modified CDS sequence (opt5) from Lassa virus__AIT17610__Z
augggcaacagacaggccaagcccaccaaaguggacgagcaccaacgggcucagcuggucccugaugccagccaucucgggccgcaguucugcaaguccuguugguuugaaaaucgcggacugguugagugcaacaaucacuaccuuugucugaacugccucucucugcuucugagcguguccucuagaugucccaucugcaaaaugccucuccccacaaagcugaaagcggcuacgcagccuagcgcccccuccaccgaagccacacaaaauucuaccccuccgcccuauacaccuuga

SEQ ID NO: 4472 - RNA, 300 nt, Artificial Sequence
  derived and/or modified CDS sequence (opt5) from Lassa virus__AIT17614__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcuacgcagcccuccgccccuucuaccgaagccacacagaauaccacacccccuccguauacccccuga

SEQ ID NO: 4473 - RNA, 300 nt, Artificial Sequence
  derived and/or modified CDS sequence (opt5) from Lassa virus__AIT17618__Z
augggcaacagacaggccaagagcaccgagguggacgaacaccaacgggcucaucugguccccgaugccucccaccucgggccucaguucugcaaaucuuguugguuugagaaucgcggacugguugaaugcaacaaucauuaccuuugucugaacugccucagccugcuucuguccgugucuaauagauguccgaucugcaagaugccccucccuacaaaacugaaggcggcuacgcagcccagcgccccuuccaccgaggccacacagaacaccacacccccuccguauacccccuga

SEQ ID NO: 4474 - RNA, 300 nt, Artificial Sequence
  derived and/or modified CDS sequence (opt5) from Lassa virus__AIT17622__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcuacgcagcccuccgccccuucuaccgaagugacacagaauaccauucccccuccguauagccccuga

SEQ ID NO: 4475 - RNA, 300 nt, Artificial Sequence
  derived and/or modified CDS sequence (opt5) from Lassa virus__AIT17628__Z
augggcaacaagcaggccaaaagcaccaagaucgacgagcaccaaagagcucaucuggugcccgaugccucccaccucgggccucaguucugcaaaucuuguugguuugaaaaucggggacuggucgagugcaacaaucauuaccuuugucugaacugccucagccugcuucuguccguuucuagccgcuguccgauuugcaagaugccccucccuacaagacugaaagcggcuacgcagcccuccgccccuucuaccgaagccacacagaauaccacacccccuccguauacccccuga

SEQ ID NO: 4476 - RNA, 300 nt, Artificial Sequence
  derived and/or modified CDS sequence (opt5) from Lassa virus__AIT17632__Z
augggcaacagacaggccaagagcaccaaaguggacgagcaccaacgggcucaucugguccccgaugccucccaccucgggccucaguucugcaagucuuguugguuugaaaauaaaggacugguugagugcaacaaucauuaccuuugucugaacugccucagccugcuucuguccgugucuagccgcuguccgaucugcaagaugccccucccuacaaaacugagagcgacggcucagcccuccgccccuucuaccgaagccauucagaauacaacacccccuccguauacccccuga

SEQ ID NO: 4477 - RNA, 300 nt, Artificial Sequence
  derived and/or modified CDS sequence (opt5) from Lassa virus__AIT17636__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcugcccagcccuccgccccuucuauugaaacgauccagaauaccacacccccuccguauacccccuga

SEQ ID NO: 4478 - RNA, 300 nt, Artificial Sequence
  derived and/or modified CDS sequence (opt5) from Lassa virus__AIT17640__Z
augggcaacagacaggccaagagcaccaaagugggggagcaccaacgggcucaucugguccccgacgccucccaccucggaccucaguucugcaagucuuguugguuugaaaaucgcggccugguugagugcaacaaucauuaccuuugucugaacugccucagccugcuucuguccgugucuagcagauguccgaucugcaaaaugccccucccuacaaagcugaaagcggcugcccagcccuccgccccuucuacggaagcuacccaggauacaacacccccuccguauacccccuga

SEQ ID NO: 4479 - RNA, 300 nt, Artificial Sequence
  derived and/or modified CDS sequence (opt5) from Lassa virus__AIT17648__Z
augggcaacagacaggccaagagcaccaaaguggacgagcaccaacgggcucaucugguccccgaugccucccaccucgggccucaguucugcaagucuuguugguuugaaaauaaaggacugguugagugcaacaaucauuaccuuugucugaacugccucagccugcuucuguccgugucuagccgcuguccgaucugcaagaugccccucccuacaaaacugaaggcgacggugcagcccuccgcuccuucuaccgaagccgcccagagcacagcucccccuccguaugcccccuga

SEQ ID NO: 4480 - RNA, 300 nt, Artificial Sequence
  derived and/or modified CDS sequence (opt5) from Lassa virus__AIT17652__Z
augggcaacagacaggccaagagcaccaaagugggggagcaccaacgggcucaucugguccccgacgccucccaccucggaccucaguucugcaagucuuguugguuugaaaaucgcggccugguugagugcaacaaucauuaccuuugucugaacugccucagccugcuucuguccgugucuagcagauguccgaucugcaaaaugccccucccuacaaagcugaaagcggcugcccagcccuccgccccuucugcugaagccauucagaagacgacacccccuccguauacccccuga

SEQ ID NO: 4481 - RNA, 300 nt, Artificial Sequence
  derived and/or modified CDS sequence (opt5) from Lassa virus__AIT17656__Z
augggcaacagacaggccaagagcaccaaaguggacgaucaccaacgggcucaucugguccccgacgccucccaccucgggccucaguucugcaagucuuguugguuugagaaucgcggacugguugaaugcaacaaucauuaccuuugucugaacugccucagccugcuucuguccgugucuagcagauguccgaucugcaaaaugccccucccuacaaagcugaaagcggcugcccagcccuccgccccuucuacggaggcugcccaggauaccacacccccuccguauacccccuga

SEQ ID NO: 4482 - RNA, 300 nt, Artificial Sequence
  derived and/or modified CDS sequence (opt5) from Lassa virus__AIT17660__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuaauagauguccgaucugcaaaaugccccucccuacaaagcugaaagcggcugcccagcccagcgccccuuccacggaagcuauucagaacaccacacccccuccguaugcccccuga

SEQ ID NO: 4483 - RNA, 300 nt, Artificial Sequence
  derived and/or modified CDS sequence (opt5) from Lassa virus__AIT17664__Z
augggcaacaagcaggccaaaagcaccaagguggacgagcaccaaagagcucaucugguccccgaugccucccaccucgggccucaguucugcaaaucuuguugguuugaaaauaagggacugguugagugcaacaaucauuaccuuugucugaacugccucagccugcuucuguccgugucuagccgguguccgaucugcaaaaugccccucccuacaaagcugaaggcggcugcccagcccuccgccccuucuacggaagcugcccagaauaccgcucccccuccguaugcccccuga

SEQ ID NO: 4484 - RNA, 300 nt, Artificial Sequence
  derived and/or modified CDS sequence (opt5) from Lassa virus__AIT17668__Z
augggcaacagacaggccaagagcaccaaaguggacgagcaccaacgggcucaucugguccccgaugccucccaccucgggccucaguucugcaagucuuguugguuugaaaauaaaggacugguugagugcaacaaucauuaccuuugucugaacugccucagccugcuucuguccgugucuagccgcuguccgaucugcaagaugccccucccuacaaaacugaagacgaccgcgcagcccuccgcuccucccacagaagccgccaagaauaccgcuccuccgcccuaugccccuuga

SEQ ID NO: 4485 - RNA, 300 nt, Artificial Sequence
  derived and/or modified CDS sequence (opt5) from Lassa virus__AIT17676__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcuacgcagcccuccgccccuucuaccgaagugacacagaauaccacacccccuccguauacccccuga

SEQ ID NO: 4486 - RNA, 300 nt, Artificial Sequence
  derived and/or modified CDS sequence (opt5) from Lassa virus__AIT17680__Z
augggcaacagacaggccaagagcaccaaaaucgacgagcaccaacgggcucaucuggugcccgaugccucccaccucgggccucaguucugcaagucuuguugguuugaaaaucgcggacuggucgagugcaacaaucauuaccuuugucugaacugccucagccugcuucuguccguuucuagcagauguccgauuugcaaaaugccccucccuacaaagcugaaagcggcugcccagcccuccgccccuucuacggaagcuauccagaauaccacacccccuccguauacccccuga

SEQ ID NO: 4487 - RNA, 300 nt, Artificial Sequence
  derived and/or modified CDS sequence (opt5) from Lassa virus__AIT17684__Z
augggcaacagacaggccaagagcgcuaaaguggacgagcaccaacgggcccaucugguccccgaugcgucccaccucgggccucaguucugcaagucuuguugguuugaaaauaaaggacugguugagugcaacaaucauuaccuuugucugaacugccucagccugcuucuguccgugucuugucgcugcccgaucuguaagaugccccucccuaccaaacugaaggcugccacacagcccagcgccccuuccacggaagcuacccagaauacaacacccccuccguauacccccuga

SEQ ID NO: 4488 - RNA, 300 nt, Artificial Sequence
  derived and/or modified CDS sequence (opt5) from Lassa virus__AIT17692__Z
augggcaacagacacgccaagcccaccaaaguggacgagcaucagcgggcucaccuggucccugaugccagccaucucgggccgcaauucugcaaguccuguugguuugaaaaucgcggacugguugagugcaacaaucacuaccuuugucugaacugccucucucugcuucugagcguguccucuagaugucccaucugcaaaaugccucuccccacaaagcugaaagcggcugcccagccuagcgcccccuccacggaagcuauucagaauaccacaccuccgcccuauaccccuuga

SEQ ID NO: 4489 - RNA, 300 nt, Artificial Sequence
  derived and/or modified CDS sequence (opt5) from Lassa virus__AIT17702__Z
augggcaacagacacgccaagagcaccaaaguggacgaacaucagcgggcucaccugguccccgaugccucccaucucgggccucaauucugcaagucuuguugguuugaaaaucgcggacugguugagugcaacaaucacuaccuuugucugaacugccucagccugcuucuguccgugucuagcagauguccgaucugcaaaaugccccucccuacaaagcugaaagcggcugcccagcccuccgccccuucuacggaggcuuuccagaauaccacacccccuccguauacccccuga

SEQ ID NO: 4490 - RNA, 300 nt, Artificial Sequence
  derived and/or modified CDS sequence (opt5) from Lassa virus__AIT17708__Z
augggcaacagacacgccaagagcaccaaaguggacgagcaucagcgggcucaccugguccccgaugccucccaucucgggccucaauucugcaagucuuguugguuugaaaaucgcggacugguugagugcaacaaucacuaccuuugucugaacugccucagccugcuucuguccgugucuagcagauguccgaucugcaaaaugccccucccuacaaagcugaaagcggcuacgcagcccuccgccccuucuaccgaagccauucagaauacaacacccccuccguauacccccuga

SEQ ID NO: 4491 - RNA, 300 nt, Artificial Sequence
  derived and/or modified CDS sequence (opt5) from Lassa virus__AIT17716__Z
augggcaacagacccgccaagagcaccaaaguggacgagcaccagcgggcucaucuggucccugaugccucccaccucgggccgcaauucugcaagucuuguugguuugaaaaucgcggacugguugagugcaacaaucauuaccuuugucugaacugccucagccugcuucuguccgugucuagcagaugucccaucugcaaaaugccucuccccacaaagcugaaagcggcugcccagccuuccgcccccucuacggaagcuacccagaauacaaccccuccgcccuauacaccuuga

SEQ ID NO: 4492 - RNA, 300 nt, Artificial Sequence
  derived and/or modified CDS sequence (opt5) from Lassa virus__AIT17720__Z
augggcaacagacaggccaagcccaccaaaguggacgagcaccaacgggcucaucuggucccugaugccagccaccucgggccgcaguucugcaaguccuguugguuugaaaaucgcggacugguugagugcaacaaucauuaccuuugucugaacugccucucucugcuucugagcguguccucuagaugucccaucugcaaaaugccucuccccacacggcugaaggcggcugcccagccuagcgcccccuccacggaagagacccagaauacaaccccuccgcccuauacaccuuga

SEQ ID NO: 4493 - RNA, 300 nt, Artificial Sequence
  derived and/or modified CDS sequence (opt5) from Lassa virus__AIT17730__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcugcccagcccuccgccccucugacggaagcuauucagaauaccacacccccuccguauacccccuga

SEQ ID NO: 4494 - RNA, 300 nt, Artificial Sequence
  derived and/or modified CDS sequence (opt5) from Lassa virus__AIT17734__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcugcccagcccuccgccccuucuacggaagcuauucagaauaccacacccccuccguauacccccuga

SEQ ID NO: 4495 - RNA, 300 nt, Artificial Sequence
  derived and/or modified CDS sequence (opt5) from Lassa virus__AIT17738__Z
augggcaacagacaggccaagagcaccaaaguggacgagcaccaacgggcucaucugguccccgaugccucccaccucgggccucaguucugcaagucuuguugguuugaaaaucgcggacugguugagugcaacaaucauuaccuuugucugaacugccucagccugcuucuguccgugucuagcagauguccgaucugcaaaaugccccucccuacaaagcugaaagcggcuacgcugcccuccgccccuucuaccgaagugacacagaauaccacacccccuccgcacagccccuga

SEQ ID NO: 4496 - RNA, 300 nt, Artificial Sequence
  derived and/or modified CDS sequence (opt5) from Lassa virus__AIT17750__Z
augggcaacagacaggccaagagcgcuaaagugaaugagcaccaacgggcccaucugguccccgacgcgucccaccucgggccucaguucugcaagucuuguugguuugaaaaccgcggacugguugagugcaauaaccauuaccuuugucugaauugccucagccugcuucuguccgugucuagcagauguccgaucugcaaaaugccccucccuaccaagcugaaagcugccacacagcccuccgccccuucuacggaagcuacccagaacacaacacccccuccguauacccccuga

SEQ ID NO: 4497 - RNA, 300 nt, Artificial Sequence
  derived and/or modified CDS sequence (opt5) from Lassa virus__AIT17754__Z
augggcaacagacaggccaagagcaccaaaguggacgagcaccaacgggcucaucugguccccgaugccucccaccucgggccucaguucugcaagucuuguugguuugaaaauaaaggacugguugagugcaacaaucauuaccuuugucugaacugccucagccugcuucuguccgugucuagccgcuguccgaucugcaagaugccccucccuacaaaacugaaggcguccgcucagcccucugccccuagcacggaagccgcucagaauaccgcucccccuccguaugcccccuga

SEQ ID NO: 4498 - RNA, 300 nt, Artificial Sequence
  derived and/or modified CDS sequence (opt5) from Lassa virus__AIT17760__Z
augggcaacagacaggccaagagcacccggacagacgagcaccaacgcgcucaucuggugcccgaugccucccaccucgggccucaguucugcaaaucuuguugguuugaaaauaagggacuggucgagugcaacaaucauuaccuuugucugaacugccucagccugcuucuguccguuucuagcagauguccgaucugcaaaaugccccucccuacgaagcugaaagcggcugcccagcccuccgccccuucuaccgaagcuggccagaauacagcucccccuccguaugcccccuga

SEQ ID NO: 4499 - RNA, 300 nt, Artificial Sequence
  derived and/or modified CDS sequence (opt5) from Lassa virus__AIT17768__Z
augggcaacagacaggccaagagcgcuaccguggacgagugccaacgggcccaccugguccccgaugcguccuaccucgggccucaguucuguaaaucuugcugguuugaaaauaagggacugguugaguguaacaaucauuaucuuugccugaacugucucagccugcuucuguccgugucuagccgcugcccgaucuguaaaaugccccucccuacaaagcugaaagcugccgcccagcccuccgcuccuucuacgagagccacccagaauacaacacccccuccguacacccccuga

SEQ ID NO: 4500 - RNA, 300 nt, Artificial Sequence
  derived and/or modified CDS sequence (opt5) from Lassa virus__AIT17776__Z
augggcaacaagcaggccaaaagcaccaagguggacgagcaccaaagagcucaucugguccccgaugccucccaccucgggccucaguucugcaaaucuuguugguuugaaaauaagggacugguugagugcaacaaucauuaccuuugucugaacugccucagccugcuucuguccgugucuagccgguguccgaucugcaaaaugccccucccuacacgccugaaggcggcugcccagcccuccgccccuucuacggaagcuacccagaaugccgcucccccuccguaugcccccuga

SEQ ID NO: 4501 - RNA, 300 nt, Artificial Sequence
  derived and/or modified CDS sequence (opt5) from Lassa virus__AIT17780__Z
augggcaacagacagaccaagagcacaaaaguggacgagcaccaacgggccuaccugguccccgaugcuucccuccuggggccucaguucugcaagucuuguugguuugaaaauaaaggacuuguugagugcaacaaucauuaucugugucucaacugccugagccuucugcucuccgugucuagccgcuguccgaucugcaagaugccccugccuacgagacugaaagccgcggcucagcccuccgccccucccaccgaagccauucagaauacaaccccuccgcccuacacaccuuga

SEQ ID NO: 4502 - RNA, 300 nt, Artificial Sequence
  derived and/or modified CDS sequence (opt5) from Lassa virus__AIT17784__Z
augggcaacagacagaccaagcccacaaaaguggacgagcaccaacgggcccaucuggucccugaugcuagccaccucgggccgcaguucugcaaguccuguugguuugaaaauaaaggacugguugagugcaacaaucauuaccuuugucugaacugccucucucugcuucugagcguguccucucgcugucccaucugcaagaugccucuccccacgaaacugaaggccaccgcgcagccuagcgcucccuccacagaagccgcccagaauaccgcuccuccgcccuaugccccuuga

SEQ ID NO: 4503 - RNA, 300 nt, Artificial Sequence
  derived and/or modified CDS sequence (opt5) from Lassa virus__AIT17788__Z
augggcaacagacaggucaagagcaccaaaguggacgagcaccaacgggcccaucugguucccgaugcuucccaccucgggccucaguucugcaagucuuguugguuugaaaaucgcggacugguggagugcaacaaucauuaccuuugucugaacugccucagccugcuucuguccgugucuagcagauguccgaucugcaaaaugccccucccuacaaagcugaaagccgcgacgcagcccuccgcuccucccaccgaagccacacagaagaccacaccuccgcccuauaccccuuga

SEQ ID NO: 4504 - RNA, 300 nt, Artificial Sequence
  derived and/or modified CDS sequence (opt5) from Lassa virus__AIT17792__Z
augggcaacaagcaggccaaaagcaccaagguggacgagcaccaaagagcucaucugguccccgaugccucccaccucgggccucaguucugcaaaucuuguugguuugaaaaucggggacugguugagugcaacaaucauuaccuuugucugaacugccucagccugcuucuguccgugucuggccgcuguccgaucugcaagaugccccucccuacaaaacugaaggcgacggcucagcccagcgccccuuccaccgaagccacacagaauaccacacccccuccguauacccccuga

SEQ ID NO: 4505 - RNA, 300 nt, Artificial Sequence
  derived and/or modified CDS sequence (opt5) from Lassa virus__AIT17796__Z
augggcaacaagcaggccaaaagcaccaagguggacgagcaccaaagagcucaucugguccccgaugccucccaccucgggccucaguucugcaaaucuuguugguuugaaaaucggggacugguugagugcaacaaucauuaccuuugucugaacugccucagccugcuucuguccgugucuagccgcuguccgaucugcaagaugccccucccuacaaaacugaaggcggcugcccagcccuccgccccuucuacggaagcuauucagaauaccacacccccuccguauacccccuga

SEQ ID NO: 4506 - RNA, 300 nt, Artificial Sequence
  derived and/or modified CDS sequence (opt5) from Lassa virus__AIT17800__Z
augggcaacaagcaggccaaagcucccgaggccaaggacagcccuagagcgucccugaucccggaugcuacccaccucgggccccaauucugcaaaucuuguugguuugaaaauaagggacugguggagugcaacaaucauuaccuuugucugaacugccucacacugcuucugagcgucuccaaucgguguccuauuugcaaaaugccccucccuacgaagcugcgccccucugccaccccuacagccccgcccaccgaagcugccgacagcaucagaccucccccuuaucaccccuga

SEQ ID NO: 4507 - RNA, 300 nt, Artificial Sequence
  derived and/or modified CDS sequence (opt5) from Lassa virus__AIT17804__Z
augggcaacaagcaggccaaagcuagcgaggaaaagaacucccccagagccucucugaucccugacgcgacccaccucgggccgcaauucugcaaaagcuguugguuugagaauaagggacugguggaaugcaauaaccauuaccuuugucugaauugccucacacugcuucuguccgucucuaaccggugucccauuugcaaaaugccucuccccacgaagcugcgcccuagcaccacacccaccgcuccuccgacaggcgccgccgauuccaucagacccccucccuauucuccuuga

SEQ ID NO: 4508 - RNA, 300 nt, Artificial Sequence
  derived and/or modified CDS sequence (opt5) from Lassa virus__AIT17808__Z
augggcaacaagcaggccaaagcucccgagagcaaggacuccccuagagccucucugaucccggaugcgacccaccucgggccccaauucugcaaaagcuguugguuugaaaauaagggacugguggagugcaacaaucauuaccuuugucugaacugccucacacugcuucuguccgucucuaaucgguguccuauuugcaaaaugccccucccuacgcgccugagacccagcgcugccccuaccgccccgcccacaggcgcugccgacuccacccggccucccccuuauucucccuga

SEQ ID NO: 4509 - RNA, 303 nt, Artificial Sequence
  derived and/or modified CDS sequence (opt5) from Lassa virus__AIT17834__Z
augggcaacaagcagaccagaagcccucccaaaccggagcacccccggccuacacugcuccccgacgccucccaucuggggccucaauucugcaagucuuguugguuugaaaauaaaggacuuguggagugcaacaaucacuaccugugucucaacugccugacgcuucugcucagcgucuccgaucgcugucccaucugcaagaugccucugccgaccaaacuggcuguuagaacacagcccucugccccuccccucaaucagggcaacacccagagcuccccucccccguauucuccuuga

SEQ ID NO: 4510 - RNA, 300 nt, Artificial Sequence
  derived and/or modified CDS sequence (opt5) from Lassa virus__AIT17838__Z
augggcaacaagcaggccaaagugcccgagagcaaggacuccccuagagcuucucugaucccggaugccacccaccucgggccccaauucugcaaaagcuguugguuugaaaauaagggacuggucgagugcaacaaucauuaccuuugucugaacugccucacacugcuucuguccguuucuaaucgguguccuauuugcaaaaugccccucccuacgaagcugaagcccagcgcggcuccuaccgccccgcccacaggcgccgcugacuccauccgcccucccccuuauucucccuga

SEQ ID NO: 4511 - RNA, 300 nt, Artificial Sequence
  derived and/or modified CDS sequence (opt5) from Lassa virus__AIT17842__Z
augggcaacaagcaggccaaagugcccgagagcaaggacuccccuagagcuucucugaucccggaugccacccaccucgggccccaauucugcaaaagcuguugguuugaaaauaagggacuggucgagugcaacaaucauuaccuuugucugaacugccucacacugcuucuguccguuucuaaucgguguccuauuugcaaaaugccccucccuacgaagcugcgccccagcgcggcuccuaccgccccgcccacaggcguggccgacuccaucagaccucccccuuauucucccuga

SEQ ID NO: 4512 - RNA, 300 nt, Artificial Sequence
  derived and/or modified CDS sequence (opt5) from Lassa virus__ANH09743__Z
augggcaacaagcaggccaaagcuagcgagguggaagacgggcccagagccucccugaucccugaugcgacccaccucggaccgcaauucugcaagucuuguugguuugagaauaaaagccuggucgaaugcaacaaucauuaccuuugucugaacugccucacacugcuucuguccguuucuaaucggugucccauuugcaagaugccucuccccacgcgccugaaaccuagcguggugcccaccgcuccuccgacaagagccggcgacgggacccggcccccucccuauuccccuuga

SEQ ID NO: 4513 - RNA, 300 nt, Artificial Sequence
  derived and/or modified CDS sequence (opt5) from Lassa virus__ANH09745__Z
augggcaacaagcagaccaaagcccccgagguggaagacgggccuagagcuagccugaucccggaugccacacaccucggaccccaauucugcaaguccuguugguuugagaauaaaggccuggucgaaugcaacaaucauuaccuuugucugaacugccucacgcugcuucugucuguuagcucccgguguccuauuugcaagaugccccucccuacccgccugaaacccucuaucgugccuacagcgccgcccgcuagaaccggggagaauacacggccucccccuuauagccccuga

SEQ ID NO: 4514 - RNA, 300 nt, Artificial Sequence
  derived and/or modified CDS sequence (opt5) from Lassa virus__ANH09749__Z
augggcaacaagcaggccaaagcucccgagguggaagacgggccuagagccagccugaucccggaugcgacccaccucggaccccaauucugcaaguccuguugguuugagaaucggggccuggucgaaugcaacaaucauuaccuuugucugaacugccucacacugcuucugucuguuagcaaucgcuguccuauuugcaaaaugccccucccuacgagacugaagcccuccguggugccuaccgcuccgcccacaggggccggaggcgacacccggccucccccuuauucucccuga

SEQ ID NO: 4515 - RNA, 300 nt, Artificial Sequence
  derived and/or modified CDS sequence (opt5) from Lassa virus__ANH09751__Z
augggcaacaagcaggccaaagcucccaaggccgaggacgggccuagagcgagccugaucccggaugcuacccaccucggaccccaauucugcaaauccuguugguuugaaaauaagggccugguggagugcaacaaucauuaccuuugucugaacugccucacacugcuucugucugucagcaaucgguguccuauuugcaaaaugccccucccuacgcgccugaagcccuccguugugccuaccgccccgcccacaggggccggaggcgacaccagaccucccccucacucucccuga

SEQ ID NO: 4516 - RNA, 300 nt, Artificial Sequence
  derived and/or modified CDS sequence (opt5) from Lassa virus__ANH09753__Z
augggcaacaagcaggccaaagcuagcgaggccgaagacgggcccagagcgucccugaucccugaugcuacccaccucggaccgcaauucugcaagucuuguugguuugagaauaaaggccugguggaaugcaacaaucauuaccuuugucugaacugccucacacugcuucugagcgucuccucucggugucccauuugcaagaugccucuccccacgcgccugagaccuagcguugugcccaccgccccuuccgccggggcuggagacggcacacggccgcccccuuauucucccuga

SEQ ID NO: 4517 - RNA, 300 nt, Artificial Sequence
  derived and/or modified CDS sequence (opt5) from Lassa virus__ANH09755__Z
augggcaacaagcagaccaaaacaaucaagaaaacggacagccccagagccucccugauuccugaugcuucucacauggggccgcaauucugcaagagcuguugguuugagaaucggggacucguggaaugcaacaaucauuaccugugucuuaacugccugucccuccugcuuucugucagcaaucgcugucccaucugcaaaaugccucugcccaccaagcucagagccuccccuucucccacagcgccuagcauucgggaggcuaacaucaccaauccgcccccuuauucccccuga

SEQ ID NO: 4518 - RNA, 300 nt, Artificial Sequence
  derived and/or modified CDS sequence (opt5) from Lassa virus__ANH09759__Z
augggcaacaagcagaccaaaacaacgaagaaaaccgacagccccagagccucccugaucccugaugcuucucacauggggccgcaauucugcaagagcuguugguuugagaaucggggacucguggaaugcaacaaucauuaccugugucuuaacugccugucccuccugcuuucugucagcaaucgcugucccauuugcaaaaugccucugcccacaaagcucagagccuccccuucucccaccgcgccuagcauccgggaggcuaacauuacaaauccgcccccuuauucccccuga

SEQ ID NO: 4519 - RNA, 300 nt, Artificial Sequence
  derived and/or modified CDS sequence (opt5) from Lassa virus__ANH09761__Z
augggcaacaaggggaccaaacccacacagaauagcgagccuuccagagccaaccuggugccggacgcuucuuaccucggaccccaauucugcaagagcuguugguuugaaaauaaaggccuggucgagugcaacaaucacuaucuuugucugaacugccucacgaugcugcuuuccguuuccaaucgguguccuaucugcaagaugccccugccuaccaaaauuaaggccagcgggucccccucugcgccuccgacagaagcuaacagcgccgugucucccccucccuacaccccuuga

SEQ ID NO: 4520 - RNA, 300 nt, Artificial Sequence
  derived and/or modified CDS sequence (opt5) from Lassa virus__AMR44579__Z
augggcgccagacagaccaagcaaccccagaucgaggggagcccucgggcuucccuggugccggacgccucucaccucggaccccaguucugcaaaagcuguugguuugaaaacaagggccuggucgagugcaauaaccauuaccuuugucugaauugccucucccugcuucugucuguuagcaaccgcuguccuauuugcaaaaugccccucccuacaaagcugagaguguccucugcgcccagcgcuccuccggccgccacggcucagcccgggaccccucccccuuauucccccuga

SEQ ID NO: 4521 - RNA, 300 nt, Artificial Sequence
  derived and/or modified CDS sequence (opt5) from Lassa virus__AMZ00378__Z
augggcaacagacagaccaaggccacagaggcuaaagacagcccccgggccucccugaucccugaugcgacgcaccucgggccgcaauucugcaagucuuguugguuugaaaauaaaggacugguggagugcaacaaucauuaccuuugucugaacugccucacccugcuucugagcgucuccucucgcugucccauuugcaagaugccucuccccacaagacugaaaagcuccaccaauccuacagcucccucugccaagaccgaaagcuccaucaacccuccgcccuauagcccuuga

SEQ ID NO: 4522 - RNA, 300 nt, Artificial Sequence
  derived and/or modified CDS sequence (opt6) from Lassa virus__ADY11072__Z
augggaaacaaacaagcaaaagcaccagaaucaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccaacaggagcagcagacucaauaagaccaccaccauacucaccauaa

SEQ ID NO: 4523 - RNA, 300 nt, Artificial Sequence
  derived and/or modified CDS sequence (opt6) from Lassa virus__AAO59514__Z
augggaaacaaacaaguacgaucaaugaaaaaaguagacucaccaagagcaucacuaauaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaaacaucaacaacaccaacagcaccaucaauaagagaagcaaacacaacaucaccaccaccauacucaccauaa

SEQ ID NO: 4524 - RNA, 300 nt, Artificial Sequence
  derived and/or modified CDS sequence (opt6) from Lassa virus__AAO59508__Z
augggaaacagacaagcaaaaaacccagaaguagaaaacucaccaagagcaucccuaauaccagacgcaacacaccuaggaccacaauucugcaaaucaugcugguucgaaaacaaaggacuaguagaaugcaacaaccacuaccuaugccuaaacugccuaucacuacuacuaucaguaucaaacagaugcccaauaugcaaaaugccacuaccaacaagacuaagaccaacaacaacaccaacagcaccccaaauaauaaaagaaaacacaacaaacccaccaccauacacaccauaa

SEQ ID NO: 4525 - RNA, 300 nt, Artificial Sequence
  derived and/or modified CDS sequence (opt6) from Lassa virus__AAO59510__Z
augggaaacaaacaaacaaaagcaccagaagcaaaagacucaccaagagcaucacuaauaccagacgcaacauaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccagcaggagcagcacacucagcaagaccaccaccauacucaccauaa

SEQ ID NO: 4526 - RNA, 300 nt, Artificial Sequence
  derived and/or modified CDS sequence (opt6) from Lassa virus__AAT48997__Z
augggaaacaaacaagcaaaagcaccagaaacaaaaaacucaccaagagcaucacuaauaccagacgcaacacaccuaggaccacaauucugcaaaucaugcugguucgaaaacaaaggacuaguagaaugcaacaaccacuaccuaugccuaaacugcuuaacacuacuacuaucaguaucaaacagaugcccaauaugcaaaaugccacuaccaacaaaacuaagaccaucagcaguaccaacagcaccaccagcacaaguaggagacagaacaagaccaccaccauacucaccauaa

SEQ ID NO: 4527 - RNA, 300 nt, Artificial Sequence
  derived and/or modified CDS sequence (opt6) from Lassa virus__AAT49005__Z
augggaaacaaacaagcaaaagcaccagaaacaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaagacuaagaccaucagcaguaccaacagcaccaccagcaccagcaggagacagaacaaaaccaccaccauacucaccauaa

SEQ ID NO: 4528 - RNA, 300 nt, Artificial Sequence
  derived and/or modified CDS sequence (opt6) from Lassa virus__ADU56612__Z
augggaaacagacaaacaagaccaacagaagcaacagaacaaucaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaagacuaaaagcaucagcacaaccaucagcaccaccaacagaagcaccacaaaacacaacaccaccaccauacacaccauaa

SEQ ID NO: 4529 - RNA, 300 nt, Artificial Sequence
  derived and/or modified CDS sequence (opt6) from Lassa virus__ADU56616__Z
augggaggaaaacacacaaaacaaccaagagaaucaaacucaccaagagcaucacuaauaccagacgcaacacaccuaggaccacaauucugcaaaucaugcugguucgaaaacaaaggacuaguagaaugcaacaaccacuaccuaugccuaaacugccuaucacuacuacuaucaguaucaaacagaugcccaauaugcaaaaugccacuaccaacaagacuaagaacaucaacaaacccaacagcaccacaaguagaacaaacaggaccagcaucaccaccaccauacucaccauaa

SEQ ID NO: 4530 - RNA, 300 nt, Artificial Sequence
  derived and/or modified CDS sequence (opt6) from Lassa virus__ADU56620__Z
augggaggaaaacacacaaaaccacaaagagaaucaaacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaagacuaagagcaucaacaaacccaacagcaccacaaguagaacaaguaggaccaacaaacccaccaccauacucaccauaa

SEQ ID NO: 4531 - RNA, 300 nt, Artificial Sequence
  derived and/or modified CDS sequence (opt6) from Lassa virus__ADU56624__Z
augggaaacagacacgcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaauacaaaacacaacaccaccaccauacacaccauaa

SEQ ID NO: 4532 - RNA, 300 nt, Artificial Sequence
  derived and/or modified CDS sequence (opt6) from Lassa virus__ADU56628__Z
augggaaacagacaagcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaauacaaaacacaacaccaccaccauacgcaccauaa

SEQ ID NO: 4533 - RNA, 300 nt, Artificial Sequence
  derived and/or modified CDS sequence (opt6) from Lassa virus__ADU56632__Z
augggaaacagacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaacacaagacacaacaccaccaccauacacaccauaa

SEQ ID NO: 4534 - RNA, 300 nt, Artificial Sequence
  derived and/or modified CDS sequence (opt6) from Lassa virus__ADU56644__Z
augggaaacagacaaacaaaagcaccagaagcaaaaggaucaccaagagcaucacuaauaccagacgcaacacaccuaggaccacaauucugcaaaucaugcugguucgaaaacaaaggacuaguagaaugcaacgaccacuaccuaugccuaaacugccuaacacuacuacuaucaguaucaucaagaugcccaauaugcaaaaugccacuaccaacaagacuaagaccaucaacaaacccaacagcaccaccagcaagagcagaaggaggaauaaacccaccaccauacucaccauaa

SEQ ID NO: 4535 - RNA, 300 nt, Artificial Sequence
  derived and/or modified CDS sequence (opt6) from Lassa virus__AHC95545__Z
augggaaacaaacaagcaaaagacccaaaaacagaaucauccccaagagcaucacuaauaccagacgcaacacaccuaggaccacaauucugcaaaucaugcugguucgaaaacaaaggacucguagaaugcaacaaccacuaccuaugccuaaacugccuaucacuacuacuaucaguaucaaacagaugcccaauaugcaaaaugccacuaccaacaaaacuaaaaccaauaacaacaccaacagcaccacaaauaacaagagaaucaauaaccaacccaccaccauacacaccauaa

SEQ ID NO: 4536 - RNA, 300 nt, Artificial Sequence
  derived and/or modified CDS sequence (opt6) from Lassa virus__AHC95547__Z
augggaaacagacaagcaaaagacccaaaaguagaaucaucaccacgagcaucacuaauaccagacgcaacacaccuaggaccacaauucugcaaaucaugcugguucgaaaacaaaggauuaguagaaugcaacaaccacuacuuaugccuaaacugccuaucacuacuacuaucaguaucaaacagaugcccaauaugcaaaaugccacuaccaacaagacuaagaccaacaacaaugccaacagcaccacaaauaauaaaagaaggaacaacaaacccaccaccauacaccccauaa

SEQ ID NO: 4537 - RNA, 300 nt, Artificial Sequence
  derived and/or modified CDS sequence (opt6) from Lassa virus__AIT17124__Z
augggaaacaaacaaguaaaaacaccagaagcaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaggaaacagaugcccaauaugcaaaaugccacuaccaacaaaacuaagaccaucaguaacaccaacagcaccaccaacaagagcagcagacucaauaggaccaccaccauacucaccauaa

SEQ ID NO: 4538 - RNA, 300 nt, Artificial Sequence
  derived and/or modified CDS sequence (opt6) from Lassa virus__AIT17128__Z
augggaaacaaacaagcaaaaacaccagaagcaaaagacucaccaagagcaaacuuaauaccagacgcaacacaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccccuaccaacaaaacuaagaccaucagcagcaccaacagcaccaccaacaggagcagcagacucaauaagaccaccaccauacucaccauaa

SEQ ID NO: 4539 - RNA, 300 nt, Artificial Sequence
  derived and/or modified CDS sequence (opt6) from Lassa virus__AIT17132__Z
augggaaacaaacaagcaaaagcaccagaagcaagagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcaacaccaacagcaccaccaacagaagcagcagacucaauaagaccaccaccauacagaccauaa

SEQ ID NO: 4540 - RNA, 300 nt, Artificial Sequence
  derived and/or modified CDS sequence (opt6) from Lassa virus__AIT17136__Z
augggaaacaaacaaacaaaagcaccagaaucaaaaaacucaccaagagcaucacuaauaccagacgcaacauaccuaggaccacaauucugcaaaucaugcugguucgaaaacaaaggacuaguagaaugcaacaaccacuacuuaugccuaaacugccuaacacuacuacuaucaguaucaaacagaugcccaauaugcaaaaugccacuaccaacaaaacuaagaucaucagcagcaccaacagcaccaccaacaggagcagcagacucaacaaaaccaccaccauacucaccauaa

SEQ ID NO: 4541 - RNA, 300 nt, Artificial Sequence
  derived and/or modified CDS sequence (opt6) from Lassa virus__AIT17140__Z
augggaaauaaacaagcaaaagcaccagaaccaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccagcaggagcaguagacucaacaagaccaccaccauacucaccauaa

SEQ ID NO: 4542 - RNA, 300 nt, Artificial Sequence
  derived and/or modified CDS sequence (opt6) from Lassa virus__AIT17144__Z
augggaaacaaacaagcaaaaacaccagaaucaaaagacucaccaagagcaucacuaauaccagacgcaacacaccuaggaccacaauucugcaaaucaugcugguucgaaaacaaaggauuaguagaaugcaacaaccacuacuuaugccuaaacugccuaacacuacuacuaggaguaucaaacagaugcccaauaugcaaaaugccacuaccaacaaaacuaagaucaucaguagcaccaacagcaccaccaacaggagcaguagacucaauaagaccaccaccauacucaccauaa

SEQ ID NO: 4543 - RNA, 300 nt, Artificial Sequence
  derived and/or modified CDS sequence (opt6) from Lassa virus__AIT17152__Z
augggaaacaaacaagcaaaaacaccagaaacaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucaacagcaccaacagcaccaccagcaggagcagcagacaacacaagaccaccaccauacucaccauaa

SEQ ID NO: 4544 - RNA, 300 nt, Artificial Sequence
  derived and/or modified CDS sequence (opt6) from Lassa virus__AIT17162__Z
augggaaacaaacaagcaaaagcaucagaaucaaaagacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccacuaccaacaaaacuaagaccaucaguaacaccaacagcaccaccaacaagaacagcagacaacacaagaccaccaccauacucaccauaa

SEQ ID NO: 4545 - RNA, 300 nt, Artificial Sequence
  derived and/or modified CDS sequence (opt6) from Lassa virus__AIT17166__Z
augggaaacaaacaagcaaaagcaccagaagcaaaagacucaccaagagcaucacuaauaccagacgcaacacaccuaggaccacaauucugcaaaucaugcugguucgaaacaaaaggauuaguagaaugcaacaaccacuaccuaugccuaaacugccuaacacuacuacuaucaguaucaaacagaugcccaauaugcaaaaugccacuaccaacaaaacuaagaccaucagcaacaccaacagcaccaccaacagaagcagcagacucaauaggaccaccaccauacucaccauaa

SEQ ID NO: 4546 - RNA, 300 nt, Artificial Sequence
  derived and/or modified CDS sequence (opt6) from Lassa virus__AIT17170__Z
augggaaacaaacaagcaaaaguaccagaaucaaaagacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccagcaggagcagcagacucaauaagaccaccaccauacucaccauaa

SEQ ID NO: 4547 - RNA, 300 nt, Artificial Sequence
  derived and/or modified CDS sequence (opt6) from Lassa virus__AIT17174__Z
augggaaacaaacaaacaaaagcaccagaagcaaaaggaucaccaagagcaucacuaauaccagacgcaacacaccuaggaccacaauucugcaaaucaugcugguucgaaaacaaaggccuaguagaaugcaacaaccacuaccuaugccuaaacugccuaacacuacuacuaucaguaucaucaagaugcccaauaugcaaaaugccacuaccaacaaaacuaagaccaucagcaguaccaacagcaccaccaacaaaagcagaagacaacacaagaccaccaccauacucaccauaa

SEQ ID NO: 4548 - RNA, 300 nt, Artificial Sequence
  derived and/or modified CDS sequence (opt6) from Lassa virus__AIT17178__Z
augggaaacaaacaagcaaaagcaucagaagcaaaagacucaccaagagcaucacuaauaccagacgcaacacaccuaggaccacaauucugcaaaucaugcugguucgaaaacaaaggacuaguagaaugcaacaaccacuaccuaugccuaaacugccuaucacuacuacuaucaguaucaucaagaugcccaauaugcaaaaugccacuaccaacaagacuaagaccaucaacagcaccaacagcaccaccagcaagagcaggagacaacauaaaaccaccaccauacucaccauaa

SEQ ID NO: 4549 - RNA, 300 nt, Artificial Sequence
  derived and/or modified CDS sequence (opt6) from Lassa virus__AIT17182__Z
augggaaacaaacaagcaaaaguaccagaaguaagagacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaucaguaucaucaagaugcccaauaugcaaaaugccacuaccaacaaaacuaagaccaucagcaacaccaacagcaccaccagcaggagcaggagacggaacaagaccaccaccauacucaccauaa

SEQ ID NO: 4550 - RNA, 300 nt, Artificial Sequence
  derived and/or modified CDS sequence (opt6) from Lassa virus__AIT17186__Z
augggaaacaaacaagcaaaaacaccagaaacaaaagacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccacuaccaacaaaacuaagaccaucaguagcaccaacagcaccaccagcaggagcagcagacaacacaagaccaccaccauacucaccauaa

SEQ ID NO: 4551 - RNA, 300 nt, Artificial Sequence
  derived and/or modified CDS sequence (opt6) from Lassa virus__AIT17194__Z
augggaaacaaacaagcaaaagcaccagaaccaaaagacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccacuaccaacaaaacuaagaccaucaguagcaccaacagcaccaccagcaggaguaguagacucaacaagaccaccaccauacucaccauaa

SEQ ID NO: 4552 - RNA, 300 nt, Artificial Sequence
  derived and/or modified CDS sequence (opt6) from Lassa virus__AIT17198__Z
augggaaacaaacaagcaaaaguaccagaaucaaaagacucaccaagagcaucacuaauaccagacgccacacaccuaggaccacaauucugcaaaucaugcugguucgaaaacagaggacuaguagaaugcaacaaccacuaccuaugccuaaacugccuaacacuacuacuaucaguaucaaacagaugcccaauaugcaaaaugccacuaccaacaaaacuaagaccaucaacagcaccaacagcaccaccaacaggagcagcagacucaacaagaccaccaccauacucaccauaa

SEQ ID NO: 4553 - RNA, 300 nt, Artificial Sequence
  derived and/or modified CDS sequence (opt6) from Lassa virus__AIT17202__Z
augggaaacaaacaagcaaaaacaccagaaucaaaagacucaccaagagcaucauuaauaccagacgcaacacaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccacuaccaacaagacuaagaccaucagcagcaccaacagcaccaccauccggagcagcagacucaacaagaccaccaccauacucaccauaa

SEQ ID NO: 4554 - RNA, 300 nt, Artificial Sequence
  derived and/or modified CDS sequence (opt6) from Lassa virus__AIT17206__Z
augggaaacaaacaagcaaaagcaccagaagcaaaagacucaccaagagcaucacuaauaccagacgcaacacaccuaggaccacaauucugcaaaucaugcugguucgaaaacaaaggacucguagaaugcaacaaccacuaccuaugccuaaacugccuaacacuacuacuaucaguaucauacagaugcccaauaugcaaaaugccacuaccaacaaaacuaagaccaucagcaacaccaacagcaccaccaacagaagcagcagacucaauaagaccaccaccauacagaccauaa

SEQ ID NO: 4555 - RNA, 300 nt, Artificial Sequence
  derived and/or modified CDS sequence (opt6) from Lassa virus__AIT17214__Z
augggaaacaaacaagcaaaagcaccagaaguaaaagacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccauuaccaacaaaacuaagaccaucagcagcaccaacagcaccaccaacaggaacagcagacucaauaagaccaccaccauacucaccauaa

SEQ ID NO: 4556 - RNA, 300 nt, Artificial Sequence
  derived and/or modified CDS sequence (opt6) from Lassa virus__AIT17222__Z
augggaaacaaacaagcaaaaacaccagaaacaaaagacucaccaagagcaucacuaauaccagacgcaacacaccuaggaccacaauucugcaaaucaugcugguucgaaaacaaaggauuaguagaaugcaacucacacuaccuaugccuaaacugccuaacacuacuacuaucaguaucaucaagaugcccaauaugcaaaaugccacuaccaacaagacuaagaccaucaacagcaccaacagcaccaccagcaggaguaggagacucaacaucaccaccaccauacucaccauaa

SEQ ID NO: 4557 - RNA, 300 nt, Artificial Sequence
  derived and/or modified CDS sequence (opt6) from Lassa virus__AIT17226__Z
augggaaacaaacaagcaaaaacaccagaagcaaaagacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccacuaccaacaaaacuaagaccaucagcaacaccaacagcaccaccagcaggagcagcagacucaauaggaccaccaccauacucaccauaa

SEQ ID NO: 4558 - RNA, 297 nt, Artificial Sequence
  derived and/or modified CDS sequence (opt6) from Lassa virus__AIT17230__Z
augggaaacaaacaagcaaaagcaucagacaaaaacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcaacaccaacagcaccaccaacaggagcagcagacucaauaagaccaccaccauacucaccauaa

SEQ ID NO: 4559 - RNA, 300 nt, Artificial Sequence
  derived and/or modified CDS sequence (opt6) from Lassa virus__AIT17234__Z
augggaaacaaacaagcaaaagcaucagaagaaaaaaacucaccaagagcaucacuaauaccagacgcaacacaccuaggaccacaauucugcaaaucaugcugguucgaaaacaaaggacuaguagaaugcaacaaccacuaccuaugcuuaaacugccuaacacuacuacuaucaguaucaaacagaugcccaauaugcaaaaugccauuaccaacaaaacuaagaccaucagcaacaccaacagcaccaccaacaggagcagcagacucaauaagaccaccaccauacucaccauaa

SEQ ID NO: 4560 - RNA, 300 nt, Artificial Sequence
  derived and/or modified CDS sequence (opt6) from Lassa virus__AIT17238__Z
augggaaacaaacaaacaaaagcaccagaagcaaaaggaucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcaacaccaacagcaccaccaacagaagcagcagacucaauaagaccaccaccauacagaccauaa

SEQ ID NO: 4561 - RNA, 300 nt, Artificial Sequence
  derived and/or modified CDS sequence (opt6) from Lassa virus__AIT17242__Z
augggaaacaaacaagcaaaagcaccagaaucaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaagacuaagaccaucagcagcaccaacagcaccaccaacaggagcaacagacucaacaagaccaccaccauacucaccauaa

SEQ ID NO: 4562 - RNA, 300 nt, Artificial Sequence
  derived and/or modified CDS sequence (opt6) from Lassa virus__AIT17248__Z
augggaaacaaacaaguaaaagcaccagaagcaagaaacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaggaguaucaucaagaugcccaauaugcaaaacaccacuaccaacaagacuaagaccaucagcaacaccaacagcaccaccagcaggagcaggagacaacacaagaccaccaccauacucaccauaa

SEQ ID NO: 4563 - RNA, 300 nt, Artificial Sequence
  derived and/or modified CDS sequence (opt6) from Lassa virus__AIT17252__Z
augggaaacaaacaagcaaaagcaccagaagcaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucaacagcaccaacagcaccaccagcaggagcagcagacucaacaagaccaccaccauacucaccauaa

SEQ ID NO: 4564 - RNA, 300 nt, Artificial Sequence
  derived and/or modified CDS sequence (opt6) from Lassa virus__AIT17256__Z
augggaaacaaacaagcaaaagcaccagaaacaaaagacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccaguaggagcagcagacaacacaagaccaccaccauacucaccauaa

SEQ ID NO: 4565 - RNA, 300 nt, Artificial Sequence
  derived and/or modified CDS sequence (opt6) from Lassa virus__AIT17260__Z
augggaaacaaacaagcaaaagcaccagaacuaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccccuaccaacaaaacuaagaccaucagcagcaccaacagcaccaccagcaggagcaguagacucaacaagaccaccaccauacucaccauaa

SEQ ID NO: 4566 - RNA, 300 nt, Artificial Sequence
  derived and/or modified CDS sequence (opt6) from Lassa virus__AIT17268__Z
augggaaacaaacaaacaaaagcaccagaaguaaaaggaucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccacuaccaacaaaacuaaaaccaucaacaacaccaacagcaccaccaacaggagcagcagacucaauaagaccaccaccauacucaccauaa

SEQ ID NO: 4567 - RNA, 300 nt, Artificial Sequence
  derived and/or modified CDS sequence (opt6) from Lassa virus__AIT17272__Z
augggaaacaaacaaguaaaaacaucagaagcaagagacucaccaagagcaucacuaauaccagacgcaacagaccuaggaccacaauucugcaaaucaugcugguucgaaaacaaaggauuaguagaaugcaacaaccacuaccuaugccuaaacugccuaacacuacuacuaucaguaucaaacagaugcccaauaugcaaaaugccacuaccaacaagacuaagaccaucagcaaacccaacagcaccaccagcagaaacaggagacucaacaagaccaccaccauacucaccauaa

SEQ ID NO: 4568 - RNA, 300 nt, Artificial Sequence
  derived and/or modified CDS sequence (opt6) from Lassa virus__AIT17278__Z
augggaucaaaacaaacaaaaacaccagaaguaaaagacucaccaagagcaucacuaauaccagacgcaacacaccuaggaccacaauucugcaaaucaugcugguucgaaaacaaaggauuaguagaaugcaacaaccacuaccuaugccuaaacugccuaacauuacuacuaucaguaucaaacagaugcccaauaugcaaaaugccauuaccaacaaaacuaagaccaucagcagcaccaacagcaccaccagcaagagcagcagacgacacaagaccaccaccauacucaccauaa

SEQ ID NO: 4569 - RNA, 300 nt, Artificial Sequence
  derived and/or modified CDS sequence (opt6) from Lassa virus__AIT17282__Z
augggaaacaaacaagcaaaagcaccagaaccaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccagcaggagcaguagacucaauaagaccaccaccauacucaccauaa

SEQ ID NO: 4570 - RNA, 300 nt, Artificial Sequence
  derived and/or modified CDS sequence (opt6) from Lassa virus__AIT17286__Z
augggaaacaaacaaacaaaagcaccagaaguaaaagacucaccacgagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccauccacagcaccaacagcaccaccagcaggaacaauggacucaacaagaccaccaccauacucaccauaa

SEQ ID NO: 4571 - RNA, 300 nt, Artificial Sequence
  derived and/or modified CDS sequence (opt6) from Lassa virus__AIT17290__Z
augggaaacaaacaagcaagagcaccagaagcaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaucaagaugcccaauaugcaaaaugccacuaccaacaagacuaagaccaucagcaauaccaacagcaccaccagcaggaacaggagacucaucaagaccaccaccauacucaccauaa

SEQ ID NO: 4572 - RNA, 300 nt, Artificial Sequence
  derived and/or modified CDS sequence (opt6) from Lassa virus__AIT17296__Z
augggaaacaaacaagcaaaaacaccagaaauaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccagcaggagcagcagacauaacaagaccaccaccauacucaccauaa

SEQ ID NO: 4573 - RNA, 300 nt, Artificial Sequence
  derived and/or modified CDS sequence (opt6) from Lassa virus__AIT17300__Z
augggaaacaaacaaguaaaagcaccagaagcaagaaacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaggaguaucaucaagaugcccaauaugcaaaaugccacuaccaacaagacuaagaccaucaacagcaccaacagcaccaccagcaggagcaggagacaacacaagaccaccaccauacucaccauaa

SEQ ID NO: 4574 - RNA, 300 nt, Artificial Sequence
  derived and/or modified CDS sequence (opt6) from Lassa virus__AIT17312__Z
augggaaacaaacaagcaaaaacaccagaaacaaaagacucaccaagagcaucacuaauaccagacgcaacacaccuaggaccacaauucugcaaaucaugcugguucgaaaacaaaggccuaguagaaugcaacaaccacuacuuaugccuaaacugccuaacacuacuacuaucaguaucaaacagaugcccaauaugcaaaaugccacuacccacaaaacuaagaccaucagcagcaccaacagcaccaccaguaggagcagcagacucaacaagaccaccaccauacucaccauaa

SEQ ID NO: 4575 - RNA, 300 nt, Artificial Sequence
  derived and/or modified CDS sequence (opt6) from Lassa virus__AIT17316__Z
augggaaacaaacaagcaaaagcaccagaagcaagaaacucaccaagagcaucacuaauaccagacgcaacacaccuaggaccacaauucugcaaaucaugcugguucgaaaacagaggauuaguagaaugcaacaaccacuaccuaugccuaaacugccuaacacuacuacuaucaguaucaucaagaugcccaauaugcaaaaugccacuaccaacaagacuaagaccaucagcagcaccaacagcaccaccagcaggagcaggagacaacacaagaccaccaccauacucaccauaa

SEQ ID NO: 4576 - RNA, 300 nt, Artificial Sequence
  derived and/or modified CDS sequence (opt6) from Lassa virus__AIT17320__Z
augggaaacaaacaagcaaaagcaccagaagcaagaaacuccccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaggaguaucaucaagaugcccaauaugcaaaaugccacuaccaacaagacuaagaccaucagcagcaccaacagcaccacuagcagaagcaggagacaacacaagaccaccaccauacucaccauaa

SEQ ID NO: 4577 - RNA, 300 nt, Artificial Sequence
  derived and/or modified CDS sequence (opt6) from Lassa virus__AIT17326__Z
augggaaacaaacaaucaaaagcaccagaaucaagagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcaacaccaacagcaccaccaacaagagcagcagacucaauaagaccaccaccauacucaccauaa

SEQ ID NO: 4578 - RNA, 300 nt, Artificial Sequence
  derived and/or modified CDS sequence (opt6) from Lassa virus__AIT17330__Z
augggaaacaaacaagcaaaagcacuagaaucaaaaaacucaccaagagcaucacuaauaccagacgcaacauaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaucaucagcagcaccaacagcaccaccaacaggagcagcagacggaacaaaaccaccaccauacucaccauaa

SEQ ID NO: 4579 - RNA, 300 nt, Artificial Sequence
  derived and/or modified CDS sequence (opt6) from Lassa virus__AIT17342__Z
augggaaacaaacaagcaaaagcaucagaagcaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucaacagcaccaacagcaccacaaacaggagcagcagacucaauaagaccaccaccauacucaccauaa

SEQ ID NO: 4580 - RNA, 300 nt, Artificial Sequence
  derived and/or modified CDS sequence (opt6) from Lassa virus__AIT17346__Z
augggaaacaaacaagcaaaagcaccagaaacaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccaguaggagcagcagacucaacaagaccaccaccauacucaccauaa

SEQ ID NO: 4581 - RNA, 300 nt, Artificial Sequence
  derived and/or modified CDS sequence (opt6) from Lassa virus__AIT17362__Z
augggaaacaaacaagcaaaagcaccagaaucaaaagacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuauuaucaguaucaaacagaugcccaauaugcaaaaugccacuaccaacaaaacuaagaccaucagcagcaccaacagcaccaccagcaggagcagcagacucaauaagaccaccaccauacucaccauaa

SEQ ID NO: 4582 - RNA, 300 nt, Artificial Sequence
  derived and/or modified CDS sequence (opt6) from Lassa virus__AIT17366__Z
augggaaacaaacaaacaaaaacaccagaaguaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccagcaagagcagcagacgacacaagaccaccaccauacucaccauaa

SEQ ID NO: 4583 - RNA, 300 nt, Artificial Sequence
  derived and/or modified CDS sequence (opt6) from Lassa virus__AIT17376__Z
augggaaacaaacaagcaaaagcaccagaaucaaaagacucaccaagagcaucacuaauaccagacgcaacauaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaucaucaguagcaccaacagcaccaccaacaagagcagcagacucaacaagaccaccaccauacucaccauaa

SEQ ID NO: 4584 - RNA, 300 nt, Artificial Sequence
  derived and/or modified CDS sequence (opt6) from Lassa virus__AIT17382__Z
augggaaacaaacaaacaaaaacaucagaaguaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccagcaagagcagcagacgacacaagaccaccaccauacucaccauaa

SEQ ID NO: 4585 - RNA, 300 nt, Artificial Sequence
  derived and/or modified CDS sequence (opt6) from Lassa virus__AIT17386__Z
augggaaacaaacaagcaaaaacaccagaagcaagagacucaccaagagcaucacuaauaccagacgcaacacaccuaggaccacaauucugcaaaucaugcugguucgaaaacaaaggauuaguagaaugcaacaaccacuaccuaugccuaaacugccuaacacuacuacuaucaguaucauccagaugcccaauaugcaaaaugccacuaccaacaaaacuaagaccaucagcaacaccaacagcaccaccagcaggagcaggagacggaacaagaccaccaccauacucaccauaa

SEQ ID NO: 4586 - RNA, 300 nt, Artificial Sequence
  derived and/or modified CDS sequence (opt6) from Lassa virus__AIT17396__Z
augggaaacaaacaaguaaaagcaccagaagcaagaaacucaccacgagcaucacuaauaccagacgcaacacaccuaggaccacaauucugcaaaucaugcugguucgaaaacaaaggacuaguagaaugcaacaaccacuaccuaugccuaaacugccuaacacuacuacuaggaguaucaucaagaugcccaauaugcaaaaugccacuaccaacaagacuaagaccaucagcagcaccaacagcaccaccagcagaagcaggagacaacacaagaccaccaccauacucaccauaa

SEQ ID NO: 4587 - RNA, 300 nt, Artificial Sequence
  derived and/or modified CDS sequence (opt6) from Lassa virus__AIT17402__Z
augggaaacagacaagcaaaaucaacaaaaguagacgaacaccaaagagcacaccuaguaccagacgcaucacaccuaggaccacaauucugcaaaucaugcugguucgaaaacagaggacucguagaaugcaacaaccacuaccuaugccuaaacugccuaucacuacuacuaucaguaucaucaagaugcccaauaugcaaaaugccauuaccaacaaaacuaaaagcagcagcacaaccaucagcaccaucaacagaaacaauacaaaacacaacaccaccaccauacacaccauaa

SEQ ID NO: 4588 - RNA, 300 nt, Artificial Sequence
  derived and/or modified CDS sequence (opt6) from Lassa virus__AIT17406__Z
augggaaacagacaagcaaaaucaucaaaaguagacgaacaccaaagagcacaccuaguaccagacgcaucacaccuaggaccacaauucugcaaaucaugcugguucgaaaacaaaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaguacaaaacacagcaccaccaccauacgcaccauaa

SEQ ID NO: 4589 - RNA, 300 nt, Artificial Sequence
  derived and/or modified CDS sequence (opt6) from Lassa virus__AIT17410__Z
augggaaacaaacaagcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaagacuaaaagcagcaacacaaccaucagcaccaucaacagaagcaacacaaaacacaacaccaccaccauacacaccauaa

SEQ ID NO: 4590 - RNA, 300 nt, Artificial Sequence
  derived and/or modified CDS sequence (opt6) from Lassa virus__AIT17418__Z
augggaaacagacaagcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcaacacaaccauccgcaccaucaacagaaacaauacaaaacacaacaccaccaccauacacaccauaa

SEQ ID NO: 4591 - RNA, 300 nt, Artificial Sequence
  derived and/or modified CDS sequence (opt6) from Lassa virus__AIT17422__Z
augggaaacagacaagcaaaaucagcaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcaacacaaccaucagcaccaucaacagaagcaacacaaaacacaacaccaccaccauacacaccauaa

SEQ ID NO: 4592 - RNA, 300 nt, Artificial Sequence
  derived and/or modified CDS sequence (opt6) from Lassa virus__AIT17426__Z
augggaaacaaacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcaacacaaccaucagcaccaucaacagaagcaacacaaaacacaacaccaccaccauacacaccauaa

SEQ ID NO: 4593 - RNA, 300 nt, Artificial Sequence
  derived and/or modified CDS sequence (opt6) from Lassa virus__AIT17432__Z
augggaaacaaacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaagacuaaaagcagcaacacaaccaucagcaccaucaacagaagcaacacaaaacacaauaccaccaccauacacaccauaa

SEQ ID NO: 4594 - RNA, 300 nt, Artificial Sequence
  derived and/or modified CDS sequence (opt6) from Lassa virus__AIT17436__Z
augggaaacaaacaagcaaaaucaacaaaagcagacgaacaccaaagagcacaccuagucccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcaacacaaccaucagcaccaucaacagaagcaacaagaaacacaacaccaccaccauacacaccauaa

SEQ ID NO: 4595 - RNA, 300 nt, Artificial Sequence
  derived and/or modified CDS sequence (opt6) from Lassa virus__AIT17444__Z
augggaaacagacaagcaaaaucaacaaaaguagacgaacaccaaagagcacaccuaguaccagacgcaucacaccuaggaccacaauucugcaaaucaugcugguucgaaaacaaaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcagcacaaaacacagcaccaccaccauacgcaccauaa

SEQ ID NO: 4596 - RNA, 300 nt, Artificial Sequence
  derived and/or modified CDS sequence (opt6) from Lassa virus__AIT17448__Z
augggaaacagacaagcaaaaucaacaaaaguaggagaacaccaaagagcacaccuaguaccagacgcaucacaccuaggaccacaauucugcaaaucaugcugguucgaaaacagaggauuagucgaaugcaacaaccacuaccuaugccuaaacugccuaucacuacuacuaucaguaucaucaagaugcccaauaugcaaaaugccacuaccaacaaaacuaaaagcaacagcacaaccaucagcaccaucagcagaagcaauacaaaacacaacaccaccaccauacacaccauaa

SEQ ID NO: 4597 - RNA, 300 nt, Artificial Sequence
  derived and/or modified CDS sequence (opt6) from Lassa virus__AIT17452__Z
augggaaacagacaagcaaaaucaacaagaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaagacuaagagcagcaguacaaccaucagcaccaucaacagaaacaacacaagacacaacaccaccaccauacucaccauaa

SEQ ID NO: 4598 - RNA, 300 nt, Artificial Sequence
  derived and/or modified CDS sequence (opt6) from Lassa virus__AIT17456__Z
augggaaaccgacaagcaaaaucaacagaaguaaacgaacaccaacgagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcaacacaaccaucagcaccaucaacagaaguaacacaaaacacaguaccaccaccauacucaccauaa

SEQ ID NO: 4599 - RNA, 300 nt, Artificial Sequence
  derived and/or modified CDS sequence (opt6) from Lassa virus__AIT17460__Z
augggaaacagacaagcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugcuuaucacuacuacuaucaguaucaucaagaugcccaauaugcaaaaugccacuaccaacaaaacuaaaagcagcagcacaaccaucagcaccaccaacagaagcaacacaaaacacaacaccaccaccauacacaccauaa

SEQ ID NO: 4600 - RNA, 300 nt, Artificial Sequence
  derived and/or modified CDS sequence (opt6) from Lassa virus__AIT17468__Z
augggaaacagacaagcaaaacaaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaauaucaucaagaugcccaauaugcaaaaugccacuaccaacaaaacuaaaagcagcagcacaaccaucagcaccaucaacagaagcaacacaagacacaacaccaccaccauacacaccauaa

SEQ ID NO: 4601 - RNA, 300 nt, Artificial Sequence
  derived and/or modified CDS sequence (opt6) from Lassa virus__AIT17472__Z
augggaaacaaacaaacaaaaucaacaaaagcagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaagacuaaaagcagcagcacaaccaucagcaccaucaacagaagcaacacaagacacaacaccaccaccauacacaccauaa

SEQ ID NO: 4602 - RNA, 300 nt, Artificial Sequence
  derived and/or modified CDS sequence (opt6) from Lassa virus__AIT17476__Z
augggaaacagacaagcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucagcagaagcaauacaaaacacaacaccaccaccauacacaccauaa

SEQ ID NO: 4603 - RNA, 300 nt, Artificial Sequence
  derived and/or modified CDS sequence (opt6) from Lassa virus__AIT17480__Z
augggaaacagacacgcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaaguaauacaaucaacaacaccaccaccauacacaccauaa

SEQ ID NO: 4604 - RNA, 300 nt, Artificial Sequence
  derived and/or modified CDS sequence (opt6) from Lassa virus__AIT17484__Z
augggaaacagacacgcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaauuaaaagcagcagcacaaccaucagcaccaucaacagaagaaauacaaaacacaacaccaccaccauacacaccauaa

SEQ ID NO: 4605 - RNA, 300 nt, Artificial Sequence
  derived and/or modified CDS sequence (opt6) from Lassa virus__AIT17488__Z
augggaaacagacaagcaaaaccaacaaaaguagacgaacaccaaagagcacaccuaguaccagacgcaucacaccuaggaccacaauucugcaaaucaugcugguucgaaaacaaaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcagcacaaaacacagcaccaccaccauacgcaccauaa

SEQ ID NO: 4606 - RNA, 300 nt, Artificial Sequence
  derived and/or modified CDS sequence (opt6) from Lassa virus__AIT17496__Z
augggaaacagacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaagacuaaaagcagcaacacaaccaucagcaccaucaacagaagcaacacaaacaacaacacccccaccauacacaccauaa

SEQ ID NO: 4607 - RNA, 300 nt, Artificial Sequence
  derived and/or modified CDS sequence (opt6) from Lassa virus__AIT17500__Z
augggaaacagacaaacaaaaucaacaaaaguagacgaacaccaaagagcacaccuaguaccagacgcaucacaccuaggaccacaauucugcaaaucaugcugguucgaaaacaaaggacucguagaaugcaacaaccacuaccuaugccuaaacugccuaucacuacuacuaucaguaucauccagaugcccaauaugcaaaaugccacuaccaacaaaacuaaaaacagcagcacaaccaucagcaccaccaacagaagcagcaagaacaacagcaccaccaccauacgcaccauaa

SEQ ID NO: 4608 - RNA, 300 nt, Artificial Sequence
  derived and/or modified CDS sequence (opt6) from Lassa virus__AIT17508__Z
augggaaacagacaaacaaaaucaacaaaaguagacgaacaccaacgagcacaccuaguaccagacgcaucacaccuaggaccacaauucugcaaaucaugcugguucgaaaacaaaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaacacaaaacacagcaccaccaccauacgcaccauaa

SEQ ID NO: 4609 - RNA, 300 nt, Artificial Sequence
  derived and/or modified CDS sequence (opt6) from Lassa virus__AIT17512__Z
augggaaacagacaagcaaaaucaacaaaaguauacgaacaccaaagagcacaccuaguaccagacgcaucacaccuaggaccacaauucugcaaaucaugcugguucgaaaacagaggacucguagaaugcaacaaccacuaccuaugccuaaacugccuaucacuacuacuaucaguaucaucaagaugcccaauaugcaaaaugccacuaccaacaagacuaaaagcagcaacacaaccaucagcaccaucaacagaagcaacacaaaacacaacaccaccaccauacacaccauaa

SEQ ID NO: 4610 - RNA, 300 nt, Artificial Sequence
  derived and/or modified CDS sequence (opt6) from Lassa virus__AIT17516__Z
augggaaacagacaagcaaaaucaacaaaaguagacgaacaccaaagagcacaccuaguaccagacgcaucacaccuaggaccacaauucugcaaaucaugcugguucgaaaacagaggccuaguagaaugcaacaaccacuaccuaugccuaaacugccuaucacuacuacuaucaguaucaucaagaugcccaauaugcaaaaugccacuaccaacaaaacuaaaaacagcaacacaaccaucagcaccacuaacagaagcaacacaaaacacaacaccaccaccauacacaccauaa

SEQ ID NO: 4611 - RNA, 300 nt, Artificial Sequence
  derived and/or modified CDS sequence (opt6) from Lassa virus__AIT17520__Z
augggaaacaaacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaaacagaugcccaauaugcaaaaugccacuaccaacaaaacuaaaagcagcagcacaaccaucagcaccaucaacagaagcaacacaaaacacaacaccaccaccauacacaccauaa

SEQ ID NO: 4612 - RNA, 300 nt, Artificial Sequence
  derived and/or modified CDS sequence (opt6) from Lassa virus__AIT17526__Z
augggaaacagacaagcaaaaucagcaaaaguaacagaacaccaaagagcacaccuaguaccagacgcaucacaccuaggaccacaauucugcaaaucaugcugguucgaaaacaaaggacuaguagaaugcaacaaccacuaccuaugccuaaacugccuaucacuacuacuaucaguaucaucaagaugcccaauaugcaaaaugccacuaccaacaagacuaaaagcagcaacacaaccaucagcaccaucagcagaagcaccacaaucaacaacaccaccaccauacacaccauaa

SEQ ID NO: 4613 - RNA, 300 nt, Artificial Sequence
  derived and/or modified CDS sequence (opt6) from Lassa virus__AIT17536__Z
augggaaacagacaaacaagaccaacagaagcaacagaacaaucaagagcacaccuaguaccagacgcaucacaccuaggaccacaauucugcaaaucaugcugguucgaaaacaaaggacuaguagaaugcaacaaccacuaccuaugccuaaacugccuaucacuacuacuaucaguaucaucaagaugcccaauaugcaaaaugccacuaccaacaagacuaaaagcaucagcacaaccaucagcaccaccaacagaagcaccacaaaacaaagcaccaccaccauacacaccauaa

SEQ ID NO: 4614 - RNA, 300 nt, Artificial Sequence
  derived and/or modified CDS sequence (opt6) from Lassa virus__AIT17542__Z
augggaaacagacaaguaaaaucaacaaaaguagacgaacaccaaagagcacaccuaauaccagacgcaucacaccuaggaccacaauucugcaaaucaugcugguucgaaaacagaggauuagucgaaugcaacaaccacuaccuaugccuaaacugccuaucacuacuacuaucaguaucaucaagaugcccaauaugcaaaaugccacuaccaacaaaacuagaagcagcagcacaaccaucagcaccaucaacagaagcaacacaagacacaacaccaccaccauacacaccauaa

SEQ ID NO: 4615 - RNA, 300 nt, Artificial Sequence
  derived and/or modified CDS sequence (opt6) from Lassa virus__AIT17546__Z
augggaaacaaacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaaacaauacaaaacacaacaccaccaccauacacaccauaa

SEQ ID NO: 4616 - RNA, 300 nt, Artificial Sequence
  derived and/or modified CDS sequence (opt6) from Lassa virus__AIT17550__Z
augggaaacagacaagcaaaacaaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaaauaacacaaaacacaacaccaccaccauacacaccauaa

SEQ ID NO: 4617 - RNA, 300 nt, Artificial Sequence
  derived and/or modified CDS sequence (opt6) from Lassa virus__AIT17554__Z
augggaaacagacaagcaaaaucaacaaaagcagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaaacagaugcccaauaugcaaaaugccacuaccaacaagacuaaaagcagcagcacaaccaucagcaccaucaacagaagcaacacaagacacaacaccaccaccauacacaccauaa

SEQ ID NO: 4618 - RNA, 300 nt, Artificial Sequence
  derived and/or modified CDS sequence (opt6) from Lassa virus__AIT17558__Z
augggaaacagacaagcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccccuaccaacaagacuaaaagcagcagcacaaccaucagcaccaucaacagaagcaauaagaucaacaacaccaccaccauacacaccauaa

SEQ ID NO: 4619 - RNA, 300 nt, Artificial Sequence
  derived and/or modified CDS sequence (opt6) from Lassa virus__AIT17570__Z
augggaaacagacaagcaaaaucagcaaaaguaaacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaacacaaaacauaacaccaccaccauacacaccauaa

SEQ ID NO: 4620 - RNA, 300 nt, Artificial Sequence
  derived and/or modified CDS sequence (opt6) from Lassa virus__AIT17578__Z
augggaaacagacaagcaaaaucaacaaaaguagacgaacaccaaagagcacaccuaguaccagacgcaucacaccuaggaccacaauucugcaaaucaugcugguucgaaaacaaaggacuaguagaaugcaacaaccacuaccuaugccuaaacugccuaucacuacuacuaucaguaucaucaagaugcccaauaugcaaaaugccacuaccaacaaaacuaagagcagcagcacaaccaucagcaccaucaacagaauccgcacaaaacacagcaccaccaccauacgcaccauaa

SEQ ID NO: 4621 - RNA, 300 nt, Artificial Sequence
  derived and/or modified CDS sequence (opt6) from Lassa virus__AIT17586__Z
augggaaacaaacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaagacuaaaagcagcagcacaaccaucagcaccaucaacagaaguaacacaaaacacaacaccaccaccauacacaccauaa

SEQ ID NO: 4622 - RNA, 300 nt, Artificial Sequence
  derived and/or modified CDS sequence (opt6) from Lassa virus__AIT17590__Z
augggaaacagacaagcaaaaucaacaaaaguagacgaacaccaaagagcacaccuaguaccagacgcaucacaccuaggaccacaauucugcaaaucaugcugguucgaaaacaaaggauuaguagaaugcaacaaccacuaccuaugccuaaacugccuaucacuacuacuaucaguaucaucaagaugcccaauaugcaaaaugccacuaccaacaaaacuagaagcaacaacacaaccaucagcaccaucaacagaagaaacacaaucaacaacaccaccaccauacacaccauaa

SEQ ID NO: 4623 - RNA, 300 nt, Artificial Sequence
  derived and/or modified CDS sequence (opt6) from Lassa virus__AIT17602__Z
augggaaacaaacaagcaaaaucaacaaaaguagacgaauaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaaacagaugcccaauaugcaaaaugccacuaccaacaagacuaaaagcagcagcacaaccaucagcaccaccaacagaagcaacacaaaacacaacaccaccaccauacacaccauaa

SEQ ID NO: 4624 - RNA, 300 nt, Artificial Sequence
  derived and/or modified CDS sequence (opt6) from Lassa virus__AIT17610__Z
augggaaacagacaagcaaaaccaacaaaaguagacgaacaccaaagagcacaacuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcaacacaaccaucagcaccaucaacagaagcaacacaaaacucaacaccaccaccauacacaccauaa

SEQ ID NO: 4625 - RNA, 300 nt, Artificial Sequence
  derived and/or modified CDS sequence (opt6) from Lassa virus__AIT17614__Z
augggaaacagacaagcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcaacacaaccaucagcaccaucaacagaagcaacacaaaacacaacaccaccaccauacacaccauaa

SEQ ID NO: 4626 - RNA, 300 nt, Artificial Sequence
  derived and/or modified CDS sequence (opt6) from Lassa virus__AIT17618__Z
augggaaacagacaagcaaaaucaacagaaguagacgaacaccaacgagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaaacagaugcccaauaugcaaaaugccacuaccaacaaaacuaaaagcagcaacacaaccaucagcaccaucaacagaagcaacacaaaacacaacaccaccaccauacacaccauaa

SEQ ID NO: 4627 - RNA, 300 nt, Artificial Sequence
  derived and/or modified CDS sequence (opt6) from Lassa virus__AIT17622__Z
augggaaacagacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcaacacaaccaucagcaccaucaacagaaguaacacaaaacacaauaccaccaccauacucaccauaa

SEQ ID NO: 4628 - RNA, 300 nt, Artificial Sequence
  derived and/or modified CDS sequence (opt6) from Lassa virus__AIT17628__Z
augggaaacaaacaagcaaaaucaacaaaaauagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaagacuaaaagcagcaacacaaccaucagcaccaucaacagaagcaacacaaaacacaacaccaccaccauacacaccauaa

SEQ ID NO: 4629 - RNA, 300 nt, Artificial Sequence
  derived and/or modified CDS sequence (opt6) from Lassa virus__AIT17632__Z
augggaaacagacaagcaaaaucaacaaaaguagacgaacaccaacgagcacaccuaguaccagacgcaucacaccuaggaccacaauucugcaaaucaugcugguucgaaaacaaaggacucguagaaugcaacaaccacuaccuaugccuaaacugccuaucacuacuacuaucaguaucaucaagaugcccaauaugcaaaaugccacuaccaacaaaacuaagagcaacagcacaaccaucagcaccaucaacagaagcaauacaaaacacaacaccaccaccauacacaccauaa

SEQ ID NO: 4630 - RNA, 300 nt, Artificial Sequence
  derived and/or modified CDS sequence (opt6) from Lassa virus__AIT17636__Z
augggaaacagacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaauagaaacaauacaaaacacaacaccaccaccauacacaccauaa

SEQ ID NO: 4631 - RNA, 300 nt, Artificial Sequence
  derived and/or modified CDS sequence (opt6) from Lassa virus__AIT17640__Z
augggaaacagacaagcaaaaucaacaaaaguaggagaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaacacaagacacaacaccaccaccauacacaccauaa

SEQ ID NO: 4632 - RNA, 300 nt, Artificial Sequence
  derived and/or modified CDS sequence (opt6) from Lassa virus__AIT17648__Z
augggaaacagacaagcaaaaucaacaaaaguagacgaacaccaaagagcacaccuaguaccagacgcaucacaccuaggaccacaauucugcaaaucaugcugguucgaaaacaaaggauuaguagaaugcaacaaccacuaccuaugccuaaacugccuaucacuacuacuaucaguaucaucaagaugcccaauaugcaaaaugccacuaccaacaaaacuaaaagcaacaguacaaccaucagcaccaucaacagaagcagcacaaucaacagcaccaccaccauacgcaccauaa

SEQ ID NO: 4633 - RNA, 300 nt, Artificial Sequence
  derived and/or modified CDS sequence (opt6) from Lassa virus__AIT17652__Z
augggaaacagacaagcaaaaucaacaaaaguaggagaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucagcagaagcaauacaaaaaacaacaccaccaccauacacaccauaa

SEQ ID NO: 4634 - RNA, 300 nt, Artificial Sequence
  derived and/or modified CDS sequence (opt6) from Lassa virus__AIT17656__Z
augggaaacagacaagcaaaaucaacaaaaguagacgaccaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcagcacaagacacaacaccaccaccauacacaccauaa

SEQ ID NO: 4635 - RNA, 300 nt, Artificial Sequence
  derived and/or modified CDS sequence (opt6) from Lassa virus__AIT17660__Z
augggaaacagacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaaacagaugcccaauaugcaaaaugccacuaccaacaaaacuaaaagcagcagcacaaccaucagcaccaucaacagaagcaauacaaaacacaacaccaccaccauacgcaccauaa

SEQ ID NO: 4636 - RNA, 300 nt, Artificial Sequence
  derived and/or modified CDS sequence (opt6) from Lassa virus__AIT17664__Z
augggaaacaaacaagcaaaaucaacaaaaguagacgaacaccaaagagcacaccuaguaccagacgcaucccaccuaggaccacaauucugcaaaucaugcugguucgaaaacaaaggccuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcagcacaaaacacagcaccaccaccauacgcaccauaa

SEQ ID NO: 4637 - RNA, 300 nt, Artificial Sequence
  derived and/or modified CDS sequence (opt6) from Lassa virus__AIT17668__Z
augggaaacagacaagcaaaaucaacaaaaguagacgaacaccaaagagcacaccuaguaccagacgcaucacaccuaggaccacaauucugcaaaucaugcugguucgaaaacaaaggacuaguagaaugcaacaaccacuacuuaugccuaaacugccuaucacuacuacuaucaguaucaucaagaugcccaauaugcaaaaugccacuaccaacaaaacuaaaaacaacagcacaaccaucagcaccaccaacagaagcagcaaaaaacacagcaccaccaccauacgcaccauaa

SEQ ID NO: 4638 - RNA, 300 nt, Artificial Sequence
  derived and/or modified CDS sequence (opt6) from Lassa virus__AIT17676__Z
augggaaacagacaagcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcaacacaaccaucagcaccaucaacagaaguaacacaaaacacaacaccaccaccauacacaccauaa

SEQ ID NO: 4639 - RNA, 300 nt, Artificial Sequence
  derived and/or modified CDS sequence (opt6) from Lassa virus__AIT17680__Z
augggaaacagacaagcaaaaucaacaaaaauagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaauacaaaacacaacaccaccaccauacacaccauaa

SEQ ID NO: 4640 - RNA, 300 nt, Artificial Sequence
  derived and/or modified CDS sequence (opt6) from Lassa virus__AIT17684__Z
augggaaacagacaagcaaaaucagcaaaaguagacgaacaccaaagagcacaccuaguaccagacgcaucacaccuaggaccacaauucugcaaaucaugcugguucgaaaacaaaggauuaguagaaugcaacaaccacuaccuaugccuaaacugccuaucacuacuacuaucaguaucaugcagaugcccaauaugcaaaaugccauuaccaacaaaacuaaaagcagcaacacaaccaucagcaccaucaacagaagcaacacaaaacacaacaccaccaccauacacaccauaa

SEQ ID NO: 4641 - RNA, 300 nt, Artificial Sequence
  derived and/or modified CDS sequence (opt6) from Lassa virus__AIT17692__Z
augggaaacagacacgcaaaaccaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaauacaaaacacaacaccaccaccauacacaccauaa

SEQ ID NO: 4642 - RNA, 300 nt, Artificial Sequence
  derived and/or modified CDS sequence (opt6) from Lassa virus__AIT17702__Z
augggaaacagacacgcaaaaucaacaaaaguagacgaacaccaacgagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcauuccaaaacacaacaccaccaccauacacaccauaa

SEQ ID NO: 4643 - RNA, 300 nt, Artificial Sequence
  derived and/or modified CDS sequence (opt6) from Lassa virus__AIT17708__Z
augggaaacagacacgcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccucucacuacuacuaucaguaucaucaagaugcccaauaugcaaaaugccacuaccaacaaaacuaaaagcagcaacacaaccaucagcaccaucaacagaagcaauacaaaacacaacaccaccaccauacacaccauaa

SEQ ID NO: 4644 - RNA, 300 nt, Artificial Sequence
  derived and/or modified CDS sequence (opt6) from Lassa virus__AIT17716__Z
augggaaaccgaccagcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaacacaaaacacaacaccaccaccauacacaccauaa

SEQ ID NO: 4645 - RNA, 300 nt, Artificial Sequence
  derived and/or modified CDS sequence (opt6) from Lassa virus__AIT17720__Z
augggaaacagacaagcaaaaccaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaagacuaaaagcagcagcacaaccaucagcaccaucaacagaagaaacacaaaacacaacaccaccaccauacacaccauaa

SEQ ID NO: 4646 - RNA, 300 nt, Artificial Sequence
  derived and/or modified CDS sequence (opt6) from Lassa virus__AIT17730__Z
augggaaacagacaagcaaaaucaacaaaaguagacgaacaccaaagagcacaccuaguaccagacgcaucacaccuaggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccacuaacagaagcaauacaaaacacaacaccaccaccauacacaccauaa

SEQ ID NO: 4647 - RNA, 300 nt, Artificial Sequence
  derived and/or modified CDS sequence (opt6) from Lassa virus__AIT17734__Z
augggaaacagacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaauacaaaacacaacaccaccaccauacacaccauaa

SEQ ID NO: 4648 - RNA, 300 nt, Artificial Sequence
  derived and/or modified CDS sequence (opt6) from Lassa virus__AIT17738__Z
augggaaacagacaagcaaaaucaacaaaaguagacgaacaccaaagagcacaccuaguaccagacgcaucacaccuaggaccacaauucugcaaaucaugcugguucgaaaacagaggacucguagaaugcaacaaccacuaccuaugccuaaacugccuaucacuacuacuaucaguaucaucaagaugcccaauaugcaaaaugccacuaccaacaaaacuaaaagcagcaacacuaccaucagcaccaucaacagaaguaacacaaaacacaacaccaccaccacacucaccauaa

SEQ ID NO: 4649 - RNA, 300 nt, Artificial Sequence
  derived and/or modified CDS sequence (opt6) from Lassa virus__AIT17750__Z
augggaaacagacaagcaaaaucagcaaaaguaaacgaacaccaaagagcacaccuaguaccagacgcaucacaccuaggaccacaauucugcaaaucaugcugguucgaaaacagaggacucguagaaugcaacaaccacuaccuaugccuaaacugccuaucacuacuacuaucaguaucaucaagaugcccaauaugcaaaaugccacuaccaacaaaauuaaaagcagcaacacaaccaucagcaccaucaacagaagcaacacaaaacacaacaccaccaccauacacaccauaa

SEQ ID NO: 4650 - RNA, 300 nt, Artificial Sequence
  derived and/or modified CDS sequence (opt6) from Lassa virus__AIT17754__Z
augggaaacagacaagcaaaaucaacaaaaguagacgaacaccaaagagcacaccuaguaccagacgcaucacaccuaggaccacaauucugcaaaucaugcugguucgaaaacaaaggacucguagaaugcaacaaccacuaccuaugccuaaacugccuaucacuacuacuaucaguaucaucaagaugcccaauaugcaaaaugccacuaccaacaaaacuaaaagcaucagcacaaccaucagcaccaucaacagaagcagcacaaaacacagcaccaccaccauacgcaccauaa

SEQ ID NO: 4651 - RNA, 300 nt, Artificial Sequence
  derived and/or modified CDS sequence (opt6) from Lassa virus__AIT17760__Z
augggaaacagacaagcaaaaucaacaagaacagacgaacaccaaagagcacaccuaguaccagacgcaucacaccuaggaccacaauucugcaaaucaugcugguucgaaaacaaaggacuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaggacaaaacacagcaccaccaccauacgcaccauaa

SEQ ID NO: 4652 - RNA, 300 nt, Artificial Sequence
  derived and/or modified CDS sequence (opt6) from Lassa virus__AIT17768__Z
augggaaaccgacaagcaaaaucagcaacaguagacgaaugccaaagagcacaccuaguaccagacgcaucauaccuaggaccacaauucugcaaaucaugcugguucgaaaacaaaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacaagagcaacacaaaacacaacaccaccaccauacacaccauaa

SEQ ID NO: 4653 - RNA, 300 nt, Artificial Sequence
  derived and/or modified CDS sequence (opt6) from Lassa virus__AIT17776__Z
augggaaacaaacaagcaaaaucaacaaaaguagacgaacaccaaagagcacaccuaguaccagacgcaucacaccuaggaccacaauucugcaaaucaugcugguucgaaaacaaaggauuaguagaaugcaacaaccacuaccuaugccuaaacugccuaucacuacuacuaucaguaucaucaagaugcccaauaugcaaaaugccacuaccaacaagacuaaaagcagcagcacaaccaucagcaccaucaacagaagcaacacaaaacgcagcaccaccaccauacgcaccauaa

SEQ ID NO: 4654 - RNA, 300 nt, Artificial Sequence
  derived and/or modified CDS sequence (opt6) from Lassa virus__AIT17780__Z
augggaaacagacaaacaaaaucaacaaaaguagacgaacaccaaagagcauaccuaguaccagacgcaucacuacuaggaccacaauucugcaaaucaugcugguucgaaaacaaaggacuaguagaaugcaacaaccacuaccuaugccuaaacugccuaucacuacuacuaucaguaucaucaagaugcccaauaugcaaaaugccacuaccaacaagacuaaaagcagcagcacaaccaucagcaccaccaacagaagcaauacaaaacacaacaccaccaccauacacaccauaa

SEQ ID NO: 4655 - RNA, 300 nt, Artificial Sequence
  derived and/or modified CDS sequence (opt6) from Lassa virus__AIT17784__Z
augggaaacagacaaacaaaaccaacaaaaguagacgaacaccaaagagcacaccuaguaccagacgcaucacaccuaggaccacaauucugcaaaucaugcugguucgaaaacaaaggacuaguagaaugcaacaaccacuaccuaugccuaaacugccuaucacuacuacuaucaguaucaucaagaugcccaauaugcaaaaugccacuaccaacaaaacuaaaagcaacagcacaaccaucagcaccaucaacagaagcagcacaaaacacagcaccaccaccauacgcaccauaa

SEQ ID NO: 4656 - RNA, 300 nt, Artificial Sequence
  derived and/or modified CDS sequence (opt6) from Lassa virus__AIT17788__Z
augggaaacagacaaguaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaucaagaugcccaauaugcaaaaugccacuaccaacaaaacuaaaagcagcaacacaaccaucagcaccaccaacagaagcaacacaaaaaacaacaccaccaccauacacaccauaa

SEQ ID NO: 4657 - RNA, 300 nt, Artificial Sequence
  derived and/or modified CDS sequence (opt6) from Lassa virus__AIT17792__Z
augggaaacaaacaagcaaaaucaacaaaaguagacgaacaccaaagagcacaccuaguaccagacgcaucacaccuaggaccacaauucugcaaaucaugcugguucgaaaacagaggacuaguagaaugcaacaaccacuaccuaugccuaaacugccuaucacuacuacuaucaguaucaggaagaugcccaauaugcaaaaugccacuaccaacaaaacuaaaagcaacagcacaaccaucagcaccaucaacagaagcaacacaaaacacaacaccaccaccauacacaccauaa

SEQ ID NO: 4658 - RNA, 300 nt, Artificial Sequence
  derived and/or modified CDS sequence (opt6) from Lassa virus__AIT17796__Z
augggaaacaaacaagcaaaaucaacaaaaguagacgaacaccaaagagcacaccuaguaccagacgcaucacaccucggaccacaauucugcaaaucaugcugguucgaaaacagaggauuaguagaaugcaacaaccacuaccuaugccuaaacugccuaucacuacuacuaucaguaucaucaagaugcccaauaugcaaaaugccacuaccaacaaaacuaaaagcagcagcacaaccaucagcaccaucaacagaagcaauacaaaacacaacaccaccaccauacacaccauaa

SEQ ID NO: 4659 - RNA, 300 nt, Artificial Sequence
  derived and/or modified CDS sequence (opt6) from Lassa virus__AIT17800__Z
augggaaacaaacaagcaaaagcaccagaagcaaaagacucaccaagagcaucacuaauaccagacgcaacacaccuaggaccacaauucugcaaaucaugcugguucgaaaacaaaggccuaguagaaugcaacaaccacuaccuaugccuaaacugccuaacacuacuauuaucaguaucaaacagaugcccaauaugcaaaaugccacuaccaacaaaacuaagaccaucagcaacaccaacagcaccaccaacagaagcagcagacucaauaagaccaccaccauaccacccauaa

SEQ ID NO: 4660 - RNA, 300 nt, Artificial Sequence
  derived and/or modified CDS sequence (opt6) from Lassa virus__AIT17804__Z
augggaaacaaacaagcaaaagcaucagaagaaaaaaacucaccaagagcaucacuaauaccagacgcaacacaccuaggaccacaauucugcaaaucaugcugguucgaaaacaaaggacuaguagaaugcaacaaccacuaccuaugcuuaaacugccuaacacuacuacuaucaguaucaaacagaugcccaauaugcaaaaugccauuaccaacaaaacuaagaccaucaacaacaccaacagcaccaccaacaggagcagcagacucaauaagaccaccaccauacucaccauaa

SEQ ID NO: 4661 - RNA, 300 nt, Artificial Sequence
  derived and/or modified CDS sequence (opt6) from Lassa virus__AIT17808__Z
augggaaacaaacaagcaaaagcaccagaaucaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaagacuaagaccaucagcagcaccaacagcaccaccaacaggagcagcagacucaacaagaccaccaccauacucaccauaa

SEQ ID NO: 4662 - RNA, 303 nt, Artificial Sequence
  derived and/or modified CDS sequence (opt6) from Lassa virus__AIT17834__Z
augggaaacaaacaaacaagaucaccaccaaaaccagaacacccaagaccaacacuacuaccagacgcaucacaccuaggaccacaauucugcaaaucaugcugguucgaaaacaaaggacuaguagaaugcaacaaccacuaccuaugccuaaacugccuaacacuacuacuaucaguaucagacagaugcccaauaugcaaaaugccacuaccaacaaaacuagcaguaagaacacaaccaucagcaccaccacuaaaccaaggaaacacacaaucaucaccaccaccauacucaccauaa

SEQ ID NO: 4663 - RNA, 300 nt, Artificial Sequence
  derived and/or modified CDS sequence (opt6) from Lassa virus__AIT17838__Z
augggaaacaaacaagcaaaaguaccagaaucaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaaaaccaucagcagcaccaacagcaccaccaacaggagcagcagacucaauaagaccaccaccauacucaccauaa

SEQ ID NO: 4664 - RNA, 300 nt, Artificial Sequence
  derived and/or modified CDS sequence (opt6) from Lassa virus__AIT17842__Z
augggaaacaaacaagcaaaaguaccagaaucaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaaaacuaagaccaucagcagcaccaacagcaccaccaacaggaguagcagacucaauaagaccaccaccauacucaccauaa

SEQ ID NO: 4665 - RNA, 300 nt, Artificial Sequence
  derived and/or modified CDS sequence (opt6) from Lassa virus__ANH09743__Z
augggaaacaaacaagcaaaagcaucagaaguagaagacggaccaagagcaucacuaauaccagacgcaacacacuuaggaccacaauucugcaaaucaugcugguucgaaaacaaaucauuaguagaaugcaacaaccacuaccuaugccuaaacugccuaacacuacuacuaucaguaucaaacagaugcccaauaugcaaaaugccacuaccaacaagacuaaaaccaucaguaguaccaacagcaccaccaacaagagcaggagacggaacaagaccaccaccauacucaccauaa

SEQ ID NO: 4666 - RNA, 300 nt, Artificial Sequence
  derived and/or modified CDS sequence (opt6) from Lassa virus__ANH09745__Z
augggaaacaaacaaacaaaagcaccagaaguagaagacggaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaucaagaugcccaauaugcaaaaugccacuaccaacaagacuaaaaccaucaauaguaccaacagcaccaccagcaagaacaggagaaaacacaagaccaccaccauacucaccauaa

SEQ ID NO: 4667 - RNA, 300 nt, Artificial Sequence
  derived and/or modified CDS sequence (opt6) from Lassa virus__ANH09749__Z
augggaaacaaacaagcaaaagcaccagaaguagaagacggaccaagagcaucacuaauaccagacgcaacacaccuaggaccacaauucugcaaaucaugcugguucgaaaacagaggauuaguagaaugcaacaaccacuaccuaugccuaaacugccuaacacuacuacuaucaguaucaaacagaugcccaauaugcaaaaugccacuaccaacaagacuaaaaccaucaguaguaccaacagcaccaccaacaggagcaggaggagacacaagaccaccaccauacucaccauaa

SEQ ID NO: 4668 - RNA, 300 nt, Artificial Sequence
  derived and/or modified CDS sequence (opt6) from Lassa virus__ANH09751__Z
augggaaacaaacaagcaaaagcaccaaaagcagaagacggaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaaacagaugcccaauaugcaaaaugccacuaccaacaagacuaaaaccaucaguaguaccaacagcaccaccaacaggagcaggaggagacacaagaccaccaccacacucaccauaa

SEQ ID NO: 4669 - RNA, 300 nt, Artificial Sequence
  derived and/or modified CDS sequence (opt6) from Lassa virus__ANH09753__Z
augggaaacaaacaagcaaaagcaucagaagcagaagacggaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaucaagaugcccaauaugcaaaaugccacuaccaacaagacuaagaccaucaguaguaccaacagcaccaucagcaggagcaggagacggaacaagaccaccaccauacucaccauaa

SEQ ID NO: 4670 - RNA, 300 nt, Artificial Sequence
  derived and/or modified CDS sequence (opt6) from Lassa virus__ANH09755__Z
augggaaacaaacaaacaaaaacaauaaaaaaaacagacucaccaagagcaucacuaauaccagacgcaucacacaugggaccacaauucugcaaaucaugcugguucgaaaacagaggacuaguagaaugcaacaaccacuacuuaugccuaaacugccuaucacuacuacuaucagucucaaacagaugcccaauaugcaaaaugccacuaccaacaaaauuaagagcaucaccaucaccaacagcaccaucaauaagagaagcaaacauaacaaacccaccaccauacucaccauaa

SEQ ID NO: 4671 - RNA, 300 nt, Artificial Sequence
  derived and/or modified CDS sequence (opt6) from Lassa virus__ANH09759__Z
augggaaacaaacaaacaaaaacaacaaaaaaaacagacucaccaagagcaucacuaauaccagacgcaucacacaugggaccacaauucugcaaaucaugcugguucgaaaacagaggacuaguagaaugcaacaaccacuacuuaugccuaaacugccuaucacuacuacuaucaguaucaaacagaugcccaauaugcaaaaugccacuaccaacaaaacuaagagcaucaccaucaccaacagcaccaucaauaagagaagcaaacauaacaaacccaccaccauacucaccauaa

SEQ ID NO: 4672 - RNA, 300 nt, Artificial Sequence
  derived and/or modified CDS sequence (opt6) from Lassa virus__ANH09761__Z
augggaaacaaaggaacaaaaccaacacaaaacucagaaccaucaagagcaaaccuaguaccagacgcaucauaccuaggaccacaauucugcaaaucaugcugguucgaaaacaaaggacuaguagaaugcaacaaccacuaccuaugccuaaacugccuaacaaugcuacuaucaguaucaaacagaugcccaauaugcaaaaugccacuaccaacaaaaauaaaagcaucaggaucaccaucagcaccaccaacagaagcaaacucagcaguaucaccaccaccauacacaccauaa

SEQ ID NO: 4673 - RNA, 300 nt, Artificial Sequence
  derived and/or modified CDS sequence (opt6) from Lassa virus__AMR44579__Z
augggagcaagacaaacaaaacaaccacaaauagaaggaucaccaagagcaucacuaguaccagacgcaucacaccuaggaccacaauucugcaaaucaugcugguucgaaaacaaaggacuaguagaaugcaacaaccacuaccuaugccuaaacugccuaucacuacuacuaucaguaucaaacagaugcccaauaugcaaaaugccacuaccaacaaaacuaagaguaucaucagcaccaucagcaccaccagcagcaacagcacaaccaggaacaccaccaccauacucaccauaa

SEQ ID NO: 4674 - RNA, 300 nt, Artificial Sequence
  derived and/or modified CDS sequence (opt6) from Lassa virus__AMZ00378__Z
augggaaacagacaaacaaaagcaacagaagcaaaagacucaccaagagcaucacuaauaccagacgcaacacaccuaggaccacaauucugcaaaucaugcugguucgaaaacaaaggacuaguagaaugcaacaaccacuaccuaugccuaaacugccuaacacuacuacuaucaguaucaucaagaugcccaauaugcaaaaugccacuaccaacaagacuaaaaucaucaacaaacccaacagcaccaucagcaaaaacagaaucaucaauaaacccaccaccauacucaccauaa

SEQ ID NO: 4675 - RNA, 300 nt, Artificial Sequence
  derived and/or modified CDS sequence (opt11) from Lassa virus__ADY11072__Z
augggcaacaaacaagccaaagcccccgaauccaaagacuccccccgcgccucccucauccccgacgccacccaccucggcccccaauucugcaaauccugcugguucgaaaacaaaggccucgucgaaugcaacaaccacuaccucugccucaacugccucacccuacuccucuccgucuccaaccgcugccccaucugcaaaaugccccuccccaccaaacuccgccccuccgccgcccccaccgccccccccaccggcgccgccgacuccauccgccccccccccuacucccccuaa

SEQ ID NO: 4676 - RNA, 300 nt, Artificial Sequence
  derived and/or modified CDS sequence (opt11) from Lassa virus__AAO59514__Z
augggcaacaaacaaguccgcuccaugaaaaaagucgacuccccccgcgccucccucauccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaaaccuccaccacccccaccgcccccuccauccgcgaagccaacaccaccucccccccccccuacucccccuaa

SEQ ID NO: 4677 - RNA, 300 nt, Artificial Sequence
  derived and/or modified CDS sequence (opt11) from Lassa virus__AAO59508__Z
augggcaaccgccaagccaaaaaccccgaagucgaaaacuccccccgcgccucccucauccccgacgccacccaccucggcccccaauucugcaaauccugcugguucgaaaacaaaggccucgucgaaugcaacaaccacuaccucugccucaacugccucucccuccuccucuccgucuccaaccgcugccccaucugcaaaaugccccuccccacccgccuccgccccaccaccacccccaccgccccccaaaucaucaaagaaaacaccaccaaccccccccccuacacccccuaa

SEQ ID NO: 4678 - RNA, 300 nt, Artificial Sequence
  derived and/or modified CDS sequence (opt11) from Lassa virus__AAO59510__Z
augggcaacaaacaaaccaaagcccccgaagccaaagacuccccccgcgccucccucauccccgacgccaccuaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccgcccccaccgccccccccgccggcgccgcccacuccgcccgccccccccccuacucccccuaa

SEQ ID NO: 4679 - RNA, 300 nt, Artificial Sequence
  derived and/or modified CDS sequence (opt11) from Lassa virus__AAT48997__Z
augggcaacaaacaagccaaagcccccgaaaccaaaaacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccguccccaccgccccccccgcccaagucggcgaccgcacccgccccccccccuacucccccuaa

SEQ ID NO: 4680 - RNA, 300 nt, Artificial Sequence
  derived and/or modified CDS sequence (opt11) from Lassa virus__AAT49005__Z
augggcaacaaacaagccaaagcccccgaaaccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccacccgccuccgccccuccgccguccccaccgccccccccgcccccgccggcgaccgcaccaaacccccccccuacucccccuaa

SEQ ID NO: 4681 - RNA, 300 nt, Artificial Sequence
  derived and/or modified CDS sequence (opt11) from Lassa virus__ADU56612__Z
augggcaaccgccaaacccgacccaccgaagccaccgaacaaucccgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccacccgccucaaagccuccgcccaacccuccgccccccccaccgaagccccccaaaacaccacccccccccccuacacccccuaa

SEQ ID NO: 4682 - RNA, 300 nt, Artificial Sequence
  derived and/or modified CDS sequence (opt11) from Lassa virus__ADU56616__Z
augggcggcaaacacaccaaacaaccccgcgaaucaaacuccccccgcgccucccucauccccgacgccacccaccucggcccccaauucugcaaauccugcugguucgaaaacaaaggccucgucgaaugcaacaaccacuaccucugccucaacugccucucccuccuccucuccgucuccaaccgcugccccaucugcaaaaugccccuccccacccgccuccgcaccuccaccaaccccaccgccccccaagucgaacaaaccggccccgccucccccccccccuacucccccuaa

SEQ ID NO: 4683 - RNA, 300 nt, Artificial Sequence
  derived and/or modified CDS sequence (opt11) from Lassa virus__ADU56620__Z
augggcggcaaacacaccaaaccccaacgcgaauccaacuccccccgcgccucccucauccccgacgccacccaccucggaccccaauucugcaaauccugcugguucgaaaacaaaggccucgucgaaugcaacaaccacuaccucugccucaacugccucacccuccuccucuccgucuccaaccgcugccccaucugcaaaaugccccuccccacccgccuccgcgccuccaccaaccccaccgccccccaagucgaacaagucggccccaccaaccccccccccuacucccccuaa

SEQ ID NO: 4684 - RNA, 300 nt, Artificial Sequence
  derived and/or modified CDS sequence (opt11) from Lassa virus__ADU56624__Z
augggcaaccgccacgccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccauccaaaacaccacccccccccccuacacccccuaa

SEQ ID NO: 4685 - RNA, 300 nt, Artificial Sequence
  derived and/or modified CDS sequence (opt11) from Lassa virus__ADU56628__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacuaaaagccgccgcccaacccuccgcccccuccaccgaagccauccaaaacaccacccccccccccuacgcccccuaa

SEQ ID NO: 4686 - RNA, 300 nt, Artificial Sequence
  derived and/or modified CDS sequence (opt11) from Lassa virus__ADU56632__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccacccaagacaccacccccccccccuacacccccuaa

SEQ ID NO: 4687 - RNA, 300 nt, Artificial Sequence
  derived and/or modified CDS sequence (opt11) from Lassa virus__ADU56644__Z
augggcaaccgccaaaccaaagcccccgaagccaaaggcuccccccgcgccucccucauccccgacgccacccaccucggcccccaauucugcaaauccugcugguucgaaaacaaaggccucgucgaaugcaacgaccacuaccucugccucaacugccucacccuccuccucuccgucuccucccgcugccccaucugcaaaaugccccuccccacccgccuccgccccuccaccaaccccaccgccccccccgcccgcgccgaaggcggcaucaaccccccccccuacucccccuaa

SEQ ID NO: 4688 - RNA, 300 nt, Artificial Sequence
  derived and/or modified CDS sequence (opt11) from Lassa virus__AHC95545__Z
augggcaacaaacaagccaaagaccccaaaaccgaauccuccccccgcgccucccucauccccgacgccacccaccucggcccccaauucugcaaauccugcugguucgaaaacaaaggccuagucgaaugcaacaaccacuaccucugccucaacugccucucccuccuccuauccgucuccaaccgcugccccaucugcaaaaugccccuccccaccaaacucaaacccaucaccacccccaccgccccccaaaucacccgcgaauccaucaccaaccccccccccuacacccccuaa

SEQ ID NO: 4689 - RNA, 300 nt, Artificial Sequence
  derived and/or modified CDS sequence (opt11) from Lassa virus__AHC95547__Z
augggcaaccgccaagccaaagaccccaaagucgaauccuccccccgcgccucccucauccccgacgccacccaccucggcccccaauucugcaaauccugcugguucgaaaacaaaggccuagucgaaugcaacaaccacuaccucugccucaacugccucucccuccuccucuccgucuccaaccgcugccccaucugcaaaaugccccuccccacccgccuccgccccacaaccaugcccaccgccccccaaaucaucaaagaaggcaccaccaaccccccccccuacacccccuaa

SEQ ID NO: 4690 - RNA, 300 nt, Artificial Sequence
  derived and/or modified CDS sequence (opt11) from Lassa virus__AIT17124__Z
augggcaacaaacaagucaaaaccccagaagccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucggcaaccgcugccccaucugcaaaaugccccuccccaccaaacuccgccccuccgucacccccaccgccccccccacccgcgccgccgacuccaucggccccccccccuacucccccuaa

SEQ ID NO: 4691 - RNA, 300 nt, Artificial Sequence
  derived and/or modified CDS sequence (opt11) from Lassa virus__AIT17128__Z
augggcaacaaacaagccaaaacccccgaagccaaagacuccccccgcgccaaccucauccccgacgccacccaccucggcccccaauucugcaaauccugcugguucgaaaacaaaggccucgucgaaugcaacaaccacuaccucugccucaacugccucacccuccuccucuccgucuccaaccgaugccccaucugcaaaaugccccuccccaccaaacuccgccccuccgccgcccccaccgccccccccaccggcgccgccgacuccauccgccccccccccuacucccccuaa

SEQ ID NO: 4692 - RNA, 300 nt, Artificial Sequence
  derived and/or modified CDS sequence (opt11) from Lassa virus__AIT17132__Z
augggcaacaaacaagccaaagcccccgaagcccgcgacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccacccccaccgccccccccaccgaagccgccgacucaauccgccccccccccuaccgccccuaa

SEQ ID NO: 4693 - RNA, 300 nt, Artificial Sequence
  derived and/or modified CDS sequence (opt11) from Lassa virus__AIT17136__Z
augggcaacaaacaaaccaaagcccccgaauccaaaaacuccccccgcgccucccuaauccccgacgccaccuaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgcuccuccgccgcccccaccgccccccccaccggcgccgccgacuccaccaaacccccccccuacucccccuaa

SEQ ID NO: 4694 - RNA, 300 nt, Artificial Sequence
  derived and/or modified CDS sequence (opt11) from Lassa virus__AIT17140__Z
augggcaacaaacaagccaaagcccccgaacccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuacccaccaaacuccgccccuccgccgcccccaccgccccccccgccggcgccgucgacuccacccgccccccccccuacucccccuaa

SEQ ID NO: 4695 - RNA, 300 nt, Artificial Sequence
  derived and/or modified CDS sequence (opt11) from Lassa virus__AIT17144__Z
augggcaacaaacaagccaaaacccccgaauccaaagacuccccccgcgccucccucauccccgacgccacccaccucggcccccaauucugcaaauccugcugguucgaaaacaaaggccucgucgaaugcaacaaccacuaccucugccucaacugccucacccuccuccucggcgucuccaaccgcugccccaucugcaaaaugccccuccccaccaaacuccgcuccuccgucgcccccaccgccccccccaccggcgccgucgacuccauccgccccccccccuacucccccuaa

SEQ ID NO: 4696 - RNA, 300 nt, Artificial Sequence
  derived and/or modified CDS sequence (opt11) from Lassa virus__AIT17152__Z
augggcaacaaacaagccaaaacccccgaaaccaaagacuccccccgcgccucccucauccccgacgcaacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccaccgcccccaccgccccccccgccggcgccgccgacaacacccgccccccccccuacucccccuaa

SEQ ID NO: 4697 - RNA, 300 nt, Artificial Sequence
  derived and/or modified CDS sequence (opt11) from Lassa virus__AIT17162__Z
augggcaacaaacaagccaaagccuccgaauccaaagacuccccccgcgccucccucauccccgacgccacccaccucggcccccaauucugcaaauccugcugguucgaaaacaaaggccucgucgaaugcaacaaccacuaccucugccucaacugccuaacccuccuccuauccgucuccaaccgcugccccaucugcaaaaugccccuccccaccaaacuccgccccuccgucacccccaccgccccccccacccgcaccgccgacaacacccgccccccccccuacucccccuaa

SEQ ID NO: 4698 - RNA, 300 nt, Artificial Sequence
  derived and/or modified CDS sequence (opt11) from Lassa virus__AIT17166__Z
augggcaacaaacaagccaaagcccccgaagccaaagacuccccccgcgccucccucauccccgacgccacccaccucggcccccaauucugcaaauccugcugguucgaaaccaaaggccucgucgaaugcaacaaccacuaccucugccucaacugccucacccuccuccucuccgucuccaaccgcugccccaucugcaaaaugccccuccccaccaaacuccgccccuccgccacccccaccgccccccccaccgaagccgccgacuccaucggccccccccccuacucccccuaa

SEQ ID NO: 4699 - RNA, 300 nt, Artificial Sequence
  derived and/or modified CDS sequence (opt11) from Lassa virus__AIT17170__Z
augggcaacaaacaagccaaaguccccgaauccaaagacuccccccgagccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccgcccccaccgccccccccgccggcgccgccgacuccauccgccccccccccuacucccccuaa

SEQ ID NO: 4700 - RNA, 300 nt, Artificial Sequence
  derived and/or modified CDS sequence (opt11) from Lassa virus__AIT17174__Z
augggcaacaaacaaaccaaagcccccgaagccaaaggcuccccccgcgccucccucauccccgacgccacccaccucggcccccaauucugcaaauccugcugguucgaaaacaaaggccucgucgaaugcaacaaccacuaccucugccucaacugccucacccuccuccucuccgucucaucccgcugccccaucugcaaaaugccccuccccaccaaacuccgccccuccgccguccccaccgccccccccaccaaagccgaagacaacacccgccccccccccuacucccccuaa

SEQ ID NO: 4701 - RNA, 300 nt, Artificial Sequence
  derived and/or modified CDS sequence (opt11) from Lassa virus__AIT17178__Z
augggcaacaaacaagccaaagccuccgaagccaaagacucaccccgcgccucccucauccccgacgccacccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccacccgccuccgccccuccaccgcccccaccgccccccccgcccgcgccggcgacaacaucaaacccccccccuacucccccuaa

SEQ ID NO: 4702 - RNA, 300 nt, Artificial Sequence
  derived and/or modified CDS sequence (opt11) from Lassa virus__AIT17182__Z
augggcaacaaacaagccaaaguccccgaaguccgcgacuccccccgcgccucccucauccccgacgccacccaccucggcccccaauucugcaaauccugcugguucgaaaacaaaggccucgucgaaugcaacaaccacuaccucugccuaaacugccucacccuccuccucuccgucuccucccgcugccccaucugcaaaaugccccuccccaccaaacuccgccccuccgccacccccaccgccccccccgccggcgccggcgacggcacccgccccccccccuacucccccuaa

SEQ ID NO: 4703 - RNA, 300 nt, Artificial Sequence
  derived and/or modified CDS sequence (opt11) from Lassa virus__AIT17186__Z
augggcaacaaacaagccaaaacccccgaaaccaaagacuccccccgagccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgucgcccccaccgccccccccgccggcgccgccgacaacacccgccccccccccuacucccccuaa

SEQ ID NO: 4704 - RNA, 300 nt, Artificial Sequence
  derived and/or modified CDS sequence (opt11) from Lassa virus__AIT17194__Z
augggcaacaaacaagccaaagcccccgaacccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgucgcccccaccgccccccccgccggcgucgucgacuccacccgccccccccccuacucccccuaa

SEQ ID NO: 4705 - RNA, 300 nt, Artificial Sequence
  derived and/or modified CDS sequence (opt11) from Lassa virus__AIT17198__Z
augggcaacaaacaagccaaaguccccgaauccaaagacuccccccgcgccucccucauccccgacgccacccaccucggcccccaauucugcaaauccugcugguucgaaaaccgcggccucgucgaaugcaacaaccacuaccucugccucaacugccucacccuccuccucuccgucuccaaccgcugccccaucugcaaaaugccccuccccaccaaacuccgccccuccaccgcccccaccgccccccccaccggcgccgccgacuccacccgccccccccccuacucccccuaa

SEQ ID NO: 4706 - RNA, 300 nt, Artificial Sequence
  derived and/or modified CDS sequence (opt11) from Lassa virus__AIT17202__Z
augggcaacaaacaagccaaaacccccgaauccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccacccgccuccgccccuccgccgcccccaccgccccccccuccggcgccgccgacuccacccgccccccccccuacucccccuaa

SEQ ID NO: 4707 - RNA, 300 nt, Artificial Sequence
  derived and/or modified CDS sequence (opt11) from Lassa virus__AIT17206__Z
augggcaacaaacaagccaaagcccccgaagccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccuaccgcugccccaucugcaaaaugccccuccccacaaaacuccgccccuccgccacccccaccgccccccccaccgaagccgccgacuccauccgccccccccccuaccgccccuaa

SEQ ID NO: 4708 - RNA, 300 nt, Artificial Sequence
  derived and/or modified CDS sequence (opt11) from Lassa virus__AIT17214__Z
augggcaacaaacaagccaaagcccccgaaguaaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccgcccccaccgccccccccaccggcaccgccgacuccauccgccccccccccuacucccccuaa

SEQ ID NO: 4709 - RNA, 300 nt, Artificial Sequence
  derived and/or modified CDS sequence (opt11) from Lassa virus__AIT17222__Z
augggcaacaaacaagccaaaacccccgaaaccaaagacuccccccgcgccucacucauccccgacgccacccaccucggcccccaauucugcaaauccugcugguucgaaaacaaaggccucgucgaaugcaacucccacuaccucugccucaacugccucacccuccuccucuccgucuccucccgcugccccaucugcaaaaugccccuacccacccgccuccgccccuccaccgcccccaccgccccccccgccggcgucggcgacuccaccucccccccccccuacucccccuaa

SEQ ID NO: 4710 - RNA, 300 nt, Artificial Sequence
  derived and/or modified CDS sequence (opt11) from Lassa virus__AIT17226__Z
augggcaacaaacaagccaaaacccccgaagccaaagacucaccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuacgccccuccgccacccccaccgccccccccgccggcgccgccgacuccaucggccccccccccuacucccccuaa

SEQ ID NO: 4711 - RNA, 297 nt, Artificial Sequence
  derived and/or modified CDS sequence (opt11) from Lassa virus__AIT17230__Z
augggcaacaaacaagccaaagccuccgacaaaaacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgacccuccgccacccccaccgccccccccaccggcgccgccgacuccauccgccccccccccuacucccccuaa

SEQ ID NO: 4712 - RNA, 300 nt, Artificial Sequence
  derived and/or modified CDS sequence (opt11) from Lassa virus__AIT17234__Z
augggcaacaaacaagccaaagccuccgaagaaaaaaacuccccccgcgccucacucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccacccccaccgccccccccaccggcgccgccgacuccauccgccccccccccuacucccccuaa

SEQ ID NO: 4713 - RNA, 300 nt, Artificial Sequence
  derived and/or modified CDS sequence (opt11) from Lassa virus__AIT17238__Z
augggcaacaaacaaaccaaagcccccgaagccaaaggcuccccccgcgccucccucauccccgacgccacccaccucggcccccaauucugcaaauccugcugguucgaaaacaaaggccucgucgaaugcaacaaccacuaccucugccucaacugccucacccuccuccuaucagucuccaaccgcugccccaucugcaaaaugccccuccccaccaaacuacgccccuccgccacccccaccgccccccccaccgaagccgccgacuccauccgccccccccccuaccgccccuaa

SEQ ID NO: 4714 - RNA, 300 nt, Artificial Sequence
  derived and/or modified CDS sequence (opt11) from Lassa virus__AIT17242__Z
augggcaacaaacaagccaaagcccccgaauccaaagacuccccccgcgccucccuaauccccgacgccacccaccucggcccccaauucugcaaauccugcugguucgaaaacaaaggccucgucgaaugcaacaaccacuaccucugccucaacugccucacccuacuccucuccgucuccaaccgcugccccaucugcaaaaugccccuccccacccgccuccgacccuccgccgcccccaccgccccccccaccggcgccaccgacuccacccgccccccccccuacucccccuaa

SEQ ID NO: 4715 - RNA, 300 nt, Artificial Sequence
  derived and/or modified CDS sequence (opt11) from Lassa virus__AIT17248__Z
augggcaacaaacaagucaaagcccccgaagcccgcaacuccccccgcgccucccucauccccgacgccacccaccucggcccccaauucugcaaauccugcugguucgaaaacaaaggccucgucgaaugcaacaaccacuaccucugccucaacugccucacccuccuccucggcgucuccucccgcugccccaucugcaaaaccccccuccccacccgccuccgccccuccgccacccccaccgccccccccgccggcgccggcgacaacacccgccccccccccuacucccccuaa

SEQ ID NO: 4716 - RNA, 300 nt, Artificial Sequence
  derived and/or modified CDS sequence (opt11) from Lassa virus__AIT17252__Z
augggcaacaaacaagccaaagcccccgaagccaaagacuccccccgcgccucccucauccccgacgccacccaccucggcccccaauucugcaaauccugcugguucgaaaacaaaggccucgucgaaugcaacaaccacuaccucugccucaacugccucacccuccuccuauccgucuccaaccgcugccccaucugcaaaaugccccuccccaccaaacuccgccccuccaccgcccccaccgccccccccgccggcgccgccgacuccacccgccccccccccuacucccccuaa

SEQ ID NO: 4717 - RNA, 300 nt, Artificial Sequence
  derived and/or modified CDS sequence (opt11) from Lassa virus__AIT17256__Z
augggcaacaaacaagccaaagcccccgaaaccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccgcccccaccgccccccccgucggcgccgccgacaacacccgccccccccccuacucccccuaa

SEQ ID NO: 4718 - RNA, 300 nt, Artificial Sequence
  derived and/or modified CDS sequence (opt11) from Lassa virus__AIT17260__Z
augggcaacaaacaagccaaagcccccgaacucaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccgcccccaccgccccccccgccggcgccgucgacuccacccgccccccccccuacucccccuaa

SEQ ID NO: 4719 - RNA, 300 nt, Artificial Sequence
  derived and/or modified CDS sequence (opt11) from Lassa virus__AIT17268__Z
augggcaacaaacaaaccaaagcccccgaagucaaaggcuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuaaaacccuccaccacccccaccgccccccccaccggcgccgccgacuccauccgccccccccccuacucccccuaa

SEQ ID NO: 4720 - RNA, 300 nt, Artificial Sequence
  derived and/or modified CDS sequence (opt11) from Lassa virus__AIT17272__Z
augggcaacaaacaagucaaaaccucagaagcccgcgacuccccccgcgccucccucauccccgacgccaccgaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccacccgccuccgccccuccgccaaccccaccgccccccccgccgaaaccggcgacuccacccgccccccccccuacucccccuaa

SEQ ID NO: 4721 - RNA, 300 nt, Artificial Sequence
  derived and/or modified CDS sequence (opt11) from Lassa virus__AIT17278__Z
augggcuccaaacaaaccaaaacccccgaagucaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccgcccccaccgccccccccgcccgcgccgccgacgacacccgccccccccccuacucccccuaa

SEQ ID NO: 4722 - RNA, 300 nt, Artificial Sequence
  derived and/or modified CDS sequence (opt11) from Lassa virus__AIT17282__Z
augggcaacaaacaagccaaagcccccgaacccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgaugccccaucugcaaaaugccccuccccaccaaacuccgccccuccgccgcccccaccgccccccccgccggcgccgucgacuccauccgccccccccccuacucccccuaa

SEQ ID NO: 4723 - RNA, 300 nt, Artificial Sequence
  derived and/or modified CDS sequence (opt11) from Lassa virus__AIT17286__Z
augggcaacaaacaaaccaaagcccccgaagucaaagacuccccccgcgccucccucauccccgacgccacccaccucggcccccaauucugcaaauccugcugguucgaaaacaaaggccucgucgaaugcaacaaccacuaccuaugccucaacugccucacccuccuccucuccgucuccaaccgcugccccaucugcaaaaugccccuacccaccaaacuccgccccuccaccgcccccaccgccccccccgccggcaccauggacuccacccgccccccccccuacucccccuaa

SEQ ID NO: 4724 - RNA, 300 nt, Artificial Sequence
  derived and/or modified CDS sequence (opt11) from Lassa virus__AIT17290__Z
augggcaacaaacaagcccgcgcccccgaagccaaagacuccccccgcgccucccucauccccgacgccacccaccucggcccccaauucugcaaauccugcugguucgaaaacaaaggccuugucgaaugcaacaaccacuaccucugccucaacugccucacccuccuccucuccgucuccucccgcugccccaucugcaaaaugccccuccccacccgccuccgccccuccgccauccccaccgccccccccgccggcaccggcgacuccucccgccccccccccuacucccccuaa

SEQ ID NO: 4725 - RNA, 300 nt, Artificial Sequence
  derived and/or modified CDS sequence (opt11) from Lassa virus__AIT17296__Z
augggcaacaaacaagccaaaacccccgaaaucaaagacuccccccgcgccucccucauccccgacgccacccaccucggcccccaauucugcaaauccugcugguucgaaaacaaaggccucgucgaaugcaacaaccacuaccucugccucaacugccucacccuccuccucucagucuccaaccgcugccccaucugcaaaaugccccuccccaccaaacuccgccccuccgccgcccccaccgccccccccgccggcgccgccgacaucacccgccccccccccuacucccccuaa

SEQ ID NO: 4726 - RNA, 300 nt, Artificial Sequence
  derived and/or modified CDS sequence (opt11) from Lassa virus__AIT17300__Z
augggcaacaaacaagucaaagcccccgaagcccgcaacuccccccgcgccucccucauccccgacgccacccaccucggcccccaauucugcaaauccugcugguucgaaaacaaaggccucgucgaaugcaacaaccacuaccucugccucaacugccucacccuccuccucggcgucuccucccgcugccccaucugcaaaaugccccuccccacccgccuccgccccuccaccgcccccaccgccccccccgccggcgccggcgacaacacccgccccccccccuacucccccuaa

SEQ ID NO: 4727 - RNA, 300 nt, Artificial Sequence
  derived and/or modified CDS sequence (opt11) from Lassa virus__AIT17312__Z
augggcaacaaacaagccaaaacccccgaaaccaaagacuccccccgcgccucccucauccccgacgccacccaccucggcccccaauucugcaaauccugcugguucgaaaacaaaggccucgucgaaugcaacaaccacuaccucugccucaacugccucacccuacuccucuccgucuccaaccgcugccccaucugcaaaaugccccuccccaccaaacuccgccccuccgccgcccccaccgccccccccgucggcgccgccgacuccacccgccccccccccuacucccccuaa

SEQ ID NO: 4728 - RNA, 300 nt, Artificial Sequence
  derived and/or modified CDS sequence (opt11) from Lassa virus__AIT17316__Z
augggcaacaaacaagccaaagcccccgaagcccgcaacuccccccgcgccucccucauccccgacgccacccaccucggcccccaauucugcaaauccugcugguucgaaaaccgcggccucgucgaaugcaacaaccacuaccucugccucaacugccucacccuccuccucuccgucuccucccgcugccccaucugcaaaaugccccuccccacccgccuccgccccuccgccgcccccaccgccccccccgccggcgccggcgacaacacccgccccccccccuacucccccuaa

SEQ ID NO: 4729 - RNA, 300 nt, Artificial Sequence
  derived and/or modified CDS sequence (opt11) from Lassa virus__AIT17320__Z
augggcaacaaacaagccaaagcccccgaagcccgcaacuccccccgcgccucccuaauccccgacgccacccaccucggcccccaauucugcaaauccugcugguucgaaaacaaaggccucgucgaaugcaacaaccacuaccucugccucaacugccucacccuccuccucggcgucuccucccgcugccccaucugcaaaaugccccuccccacccgccuccgccccuccgccgcccccaccgccccccucgccgaagccggcgacaacacccgccccccccccuacuccccauaa

SEQ ID NO: 4730 - RNA, 300 nt, Artificial Sequence
  derived and/or modified CDS sequence (opt11) from Lassa virus__AIT17326__Z
augggcaacaaacaauccaaagcccccgaaucccgcgacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccacccccaccgccccccccacccgcgccgccgacuccauccgccccccccccuacucccccuaa

SEQ ID NO: 4731 - RNA, 300 nt, Artificial Sequence
  derived and/or modified CDS sequence (opt11) from Lassa virus__AIT17330__Z
augggcaacaaacaagccaaagcccucgaauccaaaaacuccccccgcgccucccucauccccgacgccaccuaccucggcccacaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgcuccuccgccgcccccaccgccccccccaccggcgccgccgacggcaccaaacccccccccuacucccccuaa

SEQ ID NO: 4732 - RNA, 300 nt, Artificial Sequence
  derived and/or modified CDS sequence (opt11) from Lassa virus__AIT17342__Z
augggcaacaaacaagccaaagccuccgaagccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccauaugcaaaaugccccuccccaccaaacuccgccccuccaccgcccccaccgccccccaaaccggcgccgccgacuccauccgccccccccccuacucccccuaa

SEQ ID NO: 4733 - RNA, 300 nt, Artificial Sequence
  derived and/or modified CDS sequence (opt11) from Lassa virus__AIT17346__Z
augggcaacaaacaagccaaagcccccgaaaccaaagacuccccccgcgccucccucauccccgacgccacccaccucggcccccaauucugcaaauccugcugguucgaaaacaaaggccucgucgaaugcaacaaccacuaccucugccucaacugccucacccuccuccucucagucuccaaccgcugccccaucugcaaaaugccccuccccaccaaacuccgccccuccgccgcccccaccgccccccccgucggcgccgccgacuccacccgccccccccccuacucccccuaa

SEQ ID NO: 4734 - RNA, 300 nt, Artificial Sequence
  derived and/or modified CDS sequence (opt11) from Lassa virus__AIT17362__Z
augggcaacaaacaagccaaagcccccgaauccaaagacuccccccgcgccucccuaauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccgcccccaccgccccccccgccggcgccgccgacuccauccgccccccccccuacucccccuaa

SEQ ID NO: 4735 - RNA, 300 nt, Artificial Sequence
  derived and/or modified CDS sequence (opt11) from Lassa virus__AIT17366__Z
augggcaacaaacaaaccaaaacccccgaagucaaagacuccccccgcgccucccucauccccgacgccacccaccucggcccccaauucugcaaauccugcugguucgaaaacaaaggccuagucgaaugcaacaaccacuaccucugccucaacugccucacccuccuccucuccgucuccaaccgcugccccaucugcaaaaugccccuccccaccaaacuccgccccuccgccgcccccaccgccccccccgcccgcgccgccgacgacacccgccccccccccuacucccccuaa

SEQ ID NO: 4736 - RNA, 300 nt, Artificial Sequence
  derived and/or modified CDS sequence (opt11) from Lassa virus__AIT17376__Z
augggcaacaaacaagccaaagcccccgaauccaaagacuccccccgcgccucccucauccccgacgccaccuaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgcuccuccgucgcccccaccgccccccccacccgcgccgccgacuccacccgccccccccccuacucccccuaa

SEQ ID NO: 4737 - RNA, 300 nt, Artificial Sequence
  derived and/or modified CDS sequence (opt11) from Lassa virus__AIT17382__Z
augggcaacaaacaaaccaaaaccuccgaagucaaagacuccccccgcgccucacucauccccgacgccacccaccucggcccccaauucugcaaauccugcugguucgaaaacaaaggccucgucgaaugcaacaaccacuaccucugccucaacugccucacccuccuacucuccgucuccaaccgcugccccaucugcaaaaugccccuccccaccaaacuccgccccuccgccgcccccaccgccccccccgcccgcgccgccgacgacacccgccccccccccuacucccccuaa

SEQ ID NO: 4738 - RNA, 300 nt, Artificial Sequence
  derived and/or modified CDS sequence (opt11) from Lassa virus__AIT17386__Z
augggcaacaaacaagccaaaacccccgaagcccgcgacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccucccgcugccccaucugcaaaaugccccuccccaccaaacuccgccccuccgccacccccaccgccccccccgccggcgccggcgacggcacccgccccccccccuacucccccuaa

SEQ ID NO: 4739 - RNA, 300 nt, Artificial Sequence
  derived and/or modified CDS sequence (opt11) from Lassa virus__AIT17396__Z
augggcaacaaacaagucaaagcccccgaagcccgcaacuccccccgcgccucccucauccccgacgccacccaccucggcccccaauucugcaaauccugcugguucgaaaacaaaggccucgucgaaugcaacaaccacuaccucugccucaacugccucacccuccuccucggcgucuccucccgcugccccaucugcaaaaugccccuccccacccgccuccgccccucagccgcccccaccgccccccccgccgaagccggcgacaacacccgccccccccccuacucccccuaa

SEQ ID NO: 4740 - RNA, 300 nt, Artificial Sequence
  derived and/or modified CDS sequence (opt11) from Lassa virus__AIT17402__Z
augggcaaccgccaagccaaauccaccaaagucgacgaacaccaacgcgcccaccucguccccgacgccucccaccucggcccccaauucugcaaauccugcugguucgaaaaccgaggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaaaccauccaaaacaccacccccccccccuacacccccuaa

SEQ ID NO: 4741 - RNA, 300 nt, Artificial Sequence
  derived and/or modified CDS sequence (opt11) from Lassa virus__AIT17406__Z
augggcaaccgccaagccaaauccuccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgaugccccaucugcaaaaugccccuacccaccaaacucaaagccgccgcccaacccuccgcccccuccaccgaagccguccaaaacaccgcccccccccccuacgcccccuaa

SEQ ID NO: 4742 - RNA, 300 nt, Artificial Sequence
  derived and/or modified CDS sequence (opt11) from Lassa virus__AIT17410__Z
augggcaacaaacaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccacccgccucaaagccgccacccaacccuccgcccccuccaccgaagccacccaaaacaccacccccccccccuacacccccuaa

SEQ ID NO: 4743 - RNA, 300 nt, Artificial Sequence
  derived and/or modified CDS sequence (opt11) from Lassa virus__AIT17418__Z
augggcaaccgccaagccaaauccaccaaagucgacgaacaccaacgcgcccaccucguccccgacgccucccaccucggcccccaauucugcaaauccugcugguucgaaaaccgcggccuagucgaaugcaacaaccacuaccucugccucaacugccucucccuccuccucuccgucuccucccgcugccccaucugcaaaaugccccuacccaccaaacucaaagccgccacccaacccuccgcccccuccaccgaaaccauccaaaacaccacccccccccccuacacccccuaa

SEQ ID NO: 4744 - RNA, 300 nt, Artificial Sequence
  derived and/or modified CDS sequence (opt11) from Lassa virus__AIT17422__Z
augggcaaccgccaagccaaauccgccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccaacccuccgcccccuccaccgaagccacccaaaacaccacccccccccccuacacccccuaa

SEQ ID NO: 4745 - RNA, 300 nt, Artificial Sequence
  derived and/or modified CDS sequence (opt11) from Lassa virus__AIT17426__Z
augggcaacaaacaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccaacccuccgcccccuccaccgaagccacccaaaacaccacccccccccccuacacccccuaa

SEQ ID NO: 4746 - RNA, 300 nt, Artificial Sequence
  derived and/or modified CDS sequence (opt11) from Lassa virus__AIT17432__Z
augggcaacaaacaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccacccgccucaaagccgccacccaacccuccgcccccuccaccgaagccacccaaaacaccauccccccccccuacacacccuaa

SEQ ID NO: 4747 - RNA, 300 nt, Artificial Sequence
  derived and/or modified CDS sequence (opt11) from Lassa virus__AIT17436__Z
augggcaacaaacaagccaaauccaccaaagccgacgaacaccaacgcgcccaccuaguccccgacgccucccaccucggcccccaauucugcaaauccugcugguucgaaaaccgcggccucgucgaaugcaacaaccacuaccucugccucaacugccucucccuacuccucuccgucuccucccgcugccccaucugcaaaaugccccuccccaccaaacucaaagccgccacccaacccuccgcccccuccaccgaagccacccgcaacaccacccccccccccuacacccccuaa

SEQ ID NO: 4748 - RNA, 300 nt, Artificial Sequence
  derived and/or modified CDS sequence (opt11) from Lassa virus__AIT17444__Z
augggcaaccgccaagccaaauccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccgcccaaaacaccgcccccccccccuacgcccccuaa

SEQ ID NO: 4749 - RNA, 300 nt, Artificial Sequence
  derived and/or modified CDS sequence (opt11) from Lassa virus__AIT17448__Z
augggcaaccgccaagccaaauccaccaaagucggcgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucacgcugccccaucugcaaaaugccccuccccaccaaacucaaagccaccgcccaacccuccgcccccuccgccgaagccauccaaaacaccacccccccccccuacacccccuaa

SEQ ID NO: 4750 - RNA, 300 nt, Artificial Sequence
  derived and/or modified CDS sequence (opt11) from Lassa virus__AIT17452__Z
augggcaaccgccaagccaaauccacccgcgucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccacccgccuccgcgccgccguccaacccuccgcccccuccaccgaaaccacccaagacaccacccccccccccuacucccccuaa

SEQ ID NO: 4751 - RNA, 300 nt, Artificial Sequence
  derived and/or modified CDS sequence (opt11) from Lassa virus__AIT17456__Z
augggcaaccgccaagccaaauccaccgaagucaacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccaacccuccgcccccuccaccgaagucacccaaaacaccguccccccccccuacucccccuaa

SEQ ID NO: 4752 - RNA, 300 nt, Artificial Sequence
  derived and/or modified CDS sequence (opt11) from Lassa virus__AIT17460__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccuaucccuccuccucuccgucuccucccgcugccccaucugcaaaaugccccuccccaccaaacucaaagccgccgcccaacccuccgccccccccaccgaagccacccaaaacaccacccccccccccuacacccccuaa

SEQ ID NO: 4753 - RNA, 300 nt, Artificial Sequence
  derived and/or modified CDS sequence (opt11) from Lassa virus__AIT17468__Z
augggcaaccgccaagccaaacaaaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccaucuccucccgcugccccaucugcaaaaugccccuccccaccaaacucaaagccgccgcccaacccuccgcccccuccaccgaagccacccaagacaccacccccccccccuacacccccuaa

SEQ ID NO: 4754 - RNA, 300 nt, Artificial Sequence
  derived and/or modified CDS sequence (opt11) from Lassa virus__AIT17472__Z
augggcaacaaacaaaccaaauccaccaaagccgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccacccgccucaaagccgccgcccaacccuccgcccccuccaccgaagccacccaagacaccacccccccccccuacacccccuaa

SEQ ID NO: 4755 - RNA, 300 nt, Artificial Sequence
  derived and/or modified CDS sequence (opt11) from Lassa virus__AIT17476__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucucaucccgcugccccaucugcaaaaugccccuccccaccaaacucaaagccgccgcccaacccuccgcccccuccgccgaagccauccaaaacaccacccccccccccuacacccccuaa

SEQ ID NO: 4756 - RNA, 300 nt, Artificial Sequence
  derived and/or modified CDS sequence (opt11) from Lassa virus__AIT17480__Z
augggcaaccgccacgccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagucauccaauccacaacccccccccccuacacccccuaa

SEQ ID NO: 4757 - RNA, 300 nt, Artificial Sequence
  derived and/or modified CDS sequence (opt11) from Lassa virus__AIT17484__Z
augggcaaccgccacgccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagaaauccaaaacaccacccccccccccuacacccccuaa

SEQ ID NO: 4758 - RNA, 300 nt, Artificial Sequence
  derived and/or modified CDS sequence (opt11) from Lassa virus__AIT17488__Z
augggcaaccgccaagccaaacccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccgcccaaaacaccgcccccccacccuacgcccccuaa

SEQ ID NO: 4759 - RNA, 300 nt, Artificial Sequence
  derived and/or modified CDS sequence (opt11) from Lassa virus__AIT17496__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccacccgccucaaagccgccacccaacccuccgcccccuccaccgaagccacccaaaccaccacccccccccccuacacccccuaa

SEQ ID NO: 4760 - RNA, 300 nt, Artificial Sequence
  derived and/or modified CDS sequence (opt11) from Lassa virus__AIT17500__Z
augggcaaccgccaaaccaaauccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucucuucccgcugccccaucugcaaaaugccccuccccaccaaacucaaaaccgccgcccaacccuccgccccccccaccgaagccgcccgcaccaccgcccccccccccuacgcccccuaa

SEQ ID NO: 4761 - RNA, 300 nt, Artificial Sequence
  derived and/or modified CDS sequence (opt11) from Lassa virus__AIT17508__Z
augggcaaccgccaaaccaaauccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccacccaaaacaccgcccccccccccuacgcccccuaa

SEQ ID NO: 4762 - RNA, 300 nt, Artificial Sequence
  derived and/or modified CDS sequence (opt11) from Lassa virus__AIT17512__Z
augggcaaccgccaagccaaauccaccaaagucuacgaacaccaacgcgcccaccucguccccgacgccucccaccucggcccccaauucugcaaauccugcugguucgaaaaccgcggccucgucgaaugcaacaaccacuaccucugccucaacugccucucccuccuccucucagucuccucccgcugccccaucugcaaaaugccccuccccacccgccucaaagccgccacccaacccuccgcccccuccaccgaagccacccaaaacaccacccccccccccuacacccccuaa

SEQ ID NO: 4763 - RNA, 300 nt, Artificial Sequence
  derived and/or modified CDS sequence (opt11) from Lassa virus__AIT17516__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccuaaacugccucucccuccuccucuccgucuccucccgcugccccaucugcaaaaugccccuccccaccaaacucaaaaccgccacccaacccuccgccccccucaccgaagccacccaaaacaccacccccccccccuacacccccuaa

SEQ ID NO: 4764 - RNA, 300 nt, Artificial Sequence
  derived and/or modified CDS sequence (opt11) from Lassa virus__AIT17520__Z
augggcaacaaacaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccaaccgcugccccaucugcaaaaugccccuccccaccaaacucaaagccgccgcccaacccuccgcccccuccaccgaagccacccaaaacaccacccccccccccuacacccccuaa

SEQ ID NO: 4765 - RNA, 300 nt, Artificial Sequence
  derived and/or modified CDS sequence (opt11) from Lassa virus__AIT17526__Z
augggcaaccgccaagccaaauccgccaaagucaccgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccacccgccucaaagccgccacccaacccuccgcccccuccgccgaagccccccaauccaccacccccccccccuacacccccuaa

SEQ ID NO: 4766 - RNA, 300 nt, Artificial Sequence
  derived and/or modified CDS sequence (opt11) from Lassa virus__AIT17536__Z
augggcaaccgccaaacccgccccaccgaagccaccgaacaaucccgcgcccaccucguccccgacgccucccaccucggcccccaauucugcaaaucaugcugguucgaaaacaaaggccucgucgaaugcaacaaccacuaccucugccucaacugccucucccuccuccucuccgucuccucccgcugccccaucugcaaaaugccccuccccacccgccucaaagccuccgcccaacccuccgccccccccaccgaagccccccaaaacaaagcccccccccccuacacccccuaa

SEQ ID NO: 4767 - RNA, 300 nt, Artificial Sequence
  derived and/or modified CDS sequence (opt11) from Lassa virus__AIT17542__Z
augggcaaccgccaagucaaauccaccaaagucgacgaacaccaacgcgcccaccucauccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucgaagccgccgcccaacccuccgcacccuccaccgaagccacccaagacaccacccccccccccuacacccccuaa

SEQ ID NO: 4768 - RNA, 300 nt, Artificial Sequence
  derived and/or modified CDS sequence (opt11) from Lassa virus__AIT17546__Z
augggcaacaaacaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaaaccauccaaaacaccacccccccccccuacacccccuaa

SEQ ID NO: 4769 - RNA, 300 nt, Artificial Sequence
  derived and/or modified CDS sequence (opt11) from Lassa virus__AIT17550__Z
augggcaaccgccaagccaaacaaaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucucagucuccucccgcugccccaucugcaaaaugccccuccccaccaaacucaaagccgccgcccaacccuccgcccccuccaccgaaaucacccaaaacaccacccccccccccuacacccccuaa

SEQ ID NO: 4770 - RNA, 300 nt, Artificial Sequence
  derived and/or modified CDS sequence (opt11) from Lassa virus__AIT17554__Z
augggcaaccgccaagccaaauccaccaaagccgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccaaccgcugccccaucugcaaaaugccccuccccacccgccucaaagccgccgcccaacccuccgcccccuccaccgaagccacccaagacaccacccccccccccuacacccccuaa

SEQ ID NO: 4771 - RNA, 300 nt, Artificial Sequence
  derived and/or modified CDS sequence (opt11) from Lassa virus__AIT17558__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucucaucccgcugccccaucugcaaaaugccccuccccacccgccucaaagccgccgcccaacccucagcccccuccaccgaagccauccgcuccaccacccccccccccuacacccccuaa

SEQ ID NO: 4772 - RNA, 300 nt, Artificial Sequence
  derived and/or modified CDS sequence (opt11) from Lassa virus__AIT17570__Z
augggcaaccgccaagccaaauccgccaaagucaacgaacaccaacgcgcccaccucguccccgacgccucccaccucggcccccaauucugcaaauccugcugguucgaaaaccgcggccucgucgaaugcaacaaccacuaccucugccucaacugccuaucccuccuccucuccgucuccucccgcugccccaucugcaaaaugccccuccccaccaaacucaaagccgccgcccaacccuccgcccccuccaccgaagccacccaaaacaucacccccccccccuacacccccuaa

SEQ ID NO: 4773 - RNA, 300 nt, Artificial Sequence
  derived and/or modified CDS sequence (opt11) from Lassa virus__AIT17578__Z
augggcaaccgccaagccaaauccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccaccaaacuccgcgccgccgcccaacccuccgcccccuccaccgaauccgcccaaaacaccgcccccccccccuacgcccccuaa

SEQ ID NO: 4774 - RNA, 300 nt, Artificial Sequence
  derived and/or modified CDS sequence (opt11) from Lassa virus__AIT17586__Z
augggcaacaaacaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccacccgccucaaagccgccgcccaacccuccgcccccuccaccgaagucacccaaaacaccacccccccccccuacacccccuaa

SEQ ID NO: 4775 - RNA, 300 nt, Artificial Sequence
  derived and/or modified CDS sequence (opt11) from Lassa virus__AIT17590__Z
augggcaaccgccaagccaaauccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucacuccuccucuccgucuccucccgcugccccaucugcaaaaugccccuccccaccaaacucgaagccaccacccaacccuccgcccccuccaccgaagaaacccaauccaccacccccccccccuacacccccuaa

SEQ ID NO: 4776 - RNA, 300 nt, Artificial Sequence
  derived and/or modified CDS sequence (opt11) from Lassa virus__AIT17602__Z
augggcaacaaacaagccaaauccaccaaagucgacgaauaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccaaccgcugccccaucugcaaaaugccccuccccacccgccucaaagccgccgcccaacccuccgccccccccaccgaagccacccaaaacaccacccccccccccuacacccccuaa

SEQ ID NO: 4777 - RNA, 300 nt, Artificial Sequence
  derived and/or modified CDS sequence (opt11) from Lassa virus__AIT17610__Z
augggcaaccgccaagccaaacccaccaaagucgacgaacaccaacgcgcccaacucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccaacccuccgcccccucaaccgaagccacccaaaacuccacacccccacccuacacccccuaa

SEQ ID NO: 4778 - RNA, 300 nt, Artificial Sequence
  derived and/or modified CDS sequence (opt11) from Lassa virus__AIT17614__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccaacccuccgcccccuccaccgaagccacccaaaacaccacccccccccccuacacccccuaa

SEQ ID NO: 4779 - RNA, 300 nt, Artificial Sequence
  derived and/or modified CDS sequence (opt11) from Lassa virus__AIT17618__Z
augggcaaccgccaagccaaauccaccgaagucgacgaacaccaacgcgcccaccucguccccgacgccucccaccucggcccccaauucugcaaauccugcugguucgaaaaccgcggccucgucgaaugcaacaaccacuaccucugccucaacugccucucacuccuccucuccgucucaaaccgcugccccaucugcaaaaugccccuccccaccaaacucaaagccgccacccaacccuccgcccccuccaccgaagccacccaaaacaccacccccccccccuacacccccuaa

SEQ ID NO: 4780 - RNA, 300 nt, Artificial Sequence
  derived and/or modified CDS sequence (opt11) from Lassa virus__AIT17622__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccaacccuccgcccccuccaccgaagucacccaaaacaccauccccccccccuacucccccuaa

SEQ ID NO: 4781 - RNA, 300 nt, Artificial Sequence
  derived and/or modified CDS sequence (opt11) from Lassa virus__AIT17628__Z
augggcaacaaacaagccaaauccaccaaaaucgacgaacaccaacgcgcccaccucguccccgacgccucccaccuaggcccccaauucugcaaauccugcugguucgaaaaccgcggccucgucgaaugcaacaaccacuaccucugccucaacugccucucccuccuccucuccgucuccucccgcugccccaucugcaaaaugccccuccccacccgccucaaagccgccacccaacccuccgcccccuccaccgaagccacccaaaacaccacccccccccccuacacccccuaa

SEQ ID NO: 4782 - RNA, 300 nt, Artificial Sequence
  derived and/or modified CDS sequence (opt11) from Lassa virus__AIT17632__Z
augggcaaccgccaagccaaauccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccaccaaacuccgcgccaccgcccaacccuccgcccccuccaccgaagccauccaaaacaccacccccccccccuacacccccuaa

SEQ ID NO: 4783 - RNA, 300 nt, Artificial Sequence
  derived and/or modified CDS sequence (opt11) from Lassa virus__AIT17636__Z
augggcaaccgccaagccaaauccaccaaagucgacgaacaccaacgcgcccaccucgucccagacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaucgaaaccauccaaaacaccacccccccccccuacacccccuaa

SEQ ID NO: 4784 - RNA, 300 nt, Artificial Sequence
  derived and/or modified CDS sequence (opt11) from Lassa virus__AIT17640__Z
augggcaaccgccaagccaaauccaccaaagucggcgaacaccaacgagcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccacccaagacaccacccccccccccuacacccccuaa

SEQ ID NO: 4785 - RNA, 300 nt, Artificial Sequence
  derived and/or modified CDS sequence (opt11) from Lassa virus__AIT17648__Z
augggcaaccgccaagccaaauccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccaccaaacucaaagccaccguccaacccuccgcccccuccaccgaagccgcccaauccaccgcccccccccccuacgcccccuaa

SEQ ID NO: 4786 - RNA, 300 nt, Artificial Sequence
  derived and/or modified CDS sequence (opt11) from Lassa virus__AIT17652__Z
augggcaaccgccaagccaaauccaccaaagucggcgaacaccaacgcgcccaccucguccccgacgccucccaccucggcccccaauucugcaaauccugcugguucgaaaaccgcggccuagucgaaugcaacaaccacuaccucugccucaacugccucucccuccuccucuccgucuccucccgcugccccaucugcaaaaugccccuccccaccaaacucaaagccgccgcccaaccauccgcccccuccgccgaagccauccaaaaaaccacccccccccccuacacccccuaa

SEQ ID NO: 4787 - RNA, 300 nt, Artificial Sequence
  derived and/or modified CDS sequence (opt11) from Lassa virus__AIT17656__Z
augggcaaccgccaagccaaauccaccaaagucgacgaccaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacuaaaagccgccgcccaacccuccgcccccuccaccgaagccgcccaagacaccacccccccccccuacaccccauaa

SEQ ID NO: 4788 - RNA, 300 nt, Artificial Sequence
  derived and/or modified CDS sequence (opt11) from Lassa virus__AIT17660__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccaaccgcugccccaucugcaaaaugccccuccccaccaaacucaaagccgccgcccaacccuccgcacccuccaccgaagccauccaaaacaccacccccccccccuacgcccccuaa

SEQ ID NO: 4789 - RNA, 300 nt, Artificial Sequence
  derived and/or modified CDS sequence (opt11) from Lassa virus__AIT17664__Z
augggcaacaaacaagccaaauccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccgcccaaaacaccgcccccccccccuacgcccccuaa

SEQ ID NO: 4790 - RNA, 300 nt, Artificial Sequence
  derived and/or modified CDS sequence (opt11) from Lassa virus__AIT17668__Z
augggcaaccgccaagccaaauccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccaccaaacucaaaaccaccgcccaaccauccgccccccccaccgaagccgccaaaaacaccgcccccccccccuacgcccccuaa

SEQ ID NO: 4791 - RNA, 300 nt, Artificial Sequence
  derived and/or modified CDS sequence (opt11) from Lassa virus__AIT17676__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccaacccuccgcccccucaaccgaagucacccaaaacaccacccccccccccuacacccccuaa

SEQ ID NO: 4792 - RNA, 300 nt, Artificial Sequence
  derived and/or modified CDS sequence (opt11) from Lassa virus__AIT17680__Z
augggcaaccgccaagccaaauccaccaaaaucgacgaacaccaacgcgcccaccucguccccgacgccucccaccucggcccccaauucugcaaauccugcugguucgaaaaccgcggccuagucgaaugcaacaaccacuaccucugccucaacugccucucccuccuccucuccgucuccucccgcugccccaucugcaaaaugccccuccccaccaaacuaaaagccgccgcccaacccuccgcccccuccaccgaagccauccaaaacaccacccccccccccuacacccccuaa

SEQ ID NO: 4793 - RNA, 300 nt, Artificial Sequence
  derived and/or modified CDS sequence (opt11) from Lassa virus__AIT17684__Z
augggcaaccgccaagccaaauccgccaaagucgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccugccgcugccccaucugcaaaaugccccuccccaccaaacucaaagccgccacccaacccuccgcccccuccaccgaagccacccaaaacaccacccccccccccuacacccccuaa

SEQ ID NO: 4794 - RNA, 300 nt, Artificial Sequence
  derived and/or modified CDS sequence (opt11) from Lassa virus__AIT17692__Z
augggcaaccgccacgccaaacccaccaaagucgacgaacaccaacgcgcccaccucguccccgacgccucccaccucggaccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccauccaaaacaccacccccccccccuacacccccuaa

SEQ ID NO: 4795 - RNA, 300 nt, Artificial Sequence
  derived and/or modified CDS sequence (opt11) from Lassa virus__AIT17702__Z
augggcaaccgccacgccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccuuccaaaacaccacccccccccccuacacccccuaa

SEQ ID NO: 4796 - RNA, 300 nt, Artificial Sequence
  derived and/or modified CDS sequence (opt11) from Lassa virus__AIT17708__Z
augggcaaccgccacgccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccaacccuccgcccccuccaccgaagccauccaaaacaccacccccccccccuacacccccuaa

SEQ ID NO: 4797 - RNA, 300 nt, Artificial Sequence
  derived and/or modified CDS sequence (opt11) from Lassa virus__AIT17716__Z
augggcaaccgccccgccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccacccaaaacaccacccccccccccuacacccccuaa

SEQ ID NO: 4798 - RNA, 300 nt, Artificial Sequence
  derived and/or modified CDS sequence (opt11) from Lassa virus__AIT17720__Z
augggcaaccgccaagccaaacccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccacccgccucaaagccgccgcccaacccuccgcccccuccaccgaagaaacccaaaacaccacccccccccccuacacccccuaa

SEQ ID NO: 4799 - RNA, 300 nt, Artificial Sequence
  derived and/or modified CDS sequence (opt11) from Lassa virus__AIT17730__Z
augggcaaccgccaagccaaauccaccaaagucgacgaacaccaacgcgcccaccucguccccgacgccucccaccucggcccccaauucugcaaaucaugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgccccccucaccgaagccauccaaaacaccacccccccccccuacacccccuaa

SEQ ID NO: 4800 - RNA, 300 nt, Artificial Sequence
  derived and/or modified CDS sequence (opt11) from Lassa virus__AIT17734__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccauccaaaacaccacccccccccccuacacccccuaa

SEQ ID NO: 4801 - RNA, 300 nt, Artificial Sequence
  derived and/or modified CDS sequence (opt11) from Lassa virus__AIT17738__Z
augggcaaccgccaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccuccccuccgcccccuccaccgaagucacccaaaacaccaccccccccccccacucccccuaa

SEQ ID NO: 4802 - RNA, 300 nt, Artificial Sequence
  derived and/or modified CDS sequence (opt11) from Lassa virus__AIT17750__Z
augggcaaccgccaagccaaauccgccaaagucaacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccaacccuccgcccccuccaccgaagccacccaaaacaccacccccccccccuacacccccuaa

SEQ ID NO: 4803 - RNA, 300 nt, Artificial Sequence
  derived and/or modified CDS sequence (opt11) from Lassa virus__AIT17754__Z
augggcaaccgccaagccaaauccaccaaagucgacgaacaccaacgcgcccaccucguccccgacgccucccaccucggcccccaauucugcaaauccugcugguucgaaaacaaaggccucgucgaaugcaacaaccacuaccucugccucaacugccucucacuccuccuauccgucuccucccgcugccccaucugcaaaaugccccuccccaccaaacucaaagccuccgcccaacccuccgcccccuccaccgaagccgcccaaaacaccgcccccccccccuacgcccccuaa

SEQ ID NO: 4804 - RNA, 300 nt, Artificial Sequence
  derived and/or modified CDS sequence (opt11) from Lassa virus__AIT17760__Z
augggaaaccgccaagccaaauccacccgcaccgacgaacaccaacgcgcccaccucguccccgacgccucccaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccacaaaacucaaagccgccgcccaacccuccgcccccuccaccgaagccggccaaaacaccgcccccccccccuacgcccccuaa

SEQ ID NO: 4805 - RNA, 300 nt, Artificial Sequence
  derived and/or modified CDS sequence (opt11) from Lassa virus__AIT17768__Z
augggcaaccgccaagccaaauccgccaccgucgacgaaugccaacgcgcccaccucguccccgacgccuccuaccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccaccaaacucaaagccgccgcccaacccuccgcccccuccacccgcgccacccaaaacaccacccccccccccuacacccccuaa

SEQ ID NO: 4806 - RNA, 300 nt, Artificial Sequence
  derived and/or modified CDS sequence (opt11) from Lassa virus__AIT17776__Z
augggcaacaaacaagccaaauccaccaaagucgacgaacaccaacgcgcccaccucguccccgacgccucccaccucggcccccaauucugcaaauccugcugguucgaaaacaaaggccucgucgaaugcaacaaccacuaccucugccuaaacugccucucccuccuccucuccgucuccucccgcugccccaucugcaaaaugccccuccccacccgccuaaaagcagccgcccaacccuccgcccccuccaccgaagccacccaaaacgccgcccccccccccuacgcccccuaa

SEQ ID NO: 4807 - RNA, 300 nt, Artificial Sequence
  derived and/or modified CDS sequence (opt11) from Lassa virus__AIT17780__Z
augggcaaccgccaaaccaaauccaccaaagucgacgaacaccaacgcgccuaccucguccccgacgccucccuccucggcccccaauucugcaaauccugcugguucgaaaacaaaggccucgucgaaugcaacaaccacuaccucugccucaacugccucucccuccuccucuccgucuccucccgcugccccaucugcaaaaugccccuccccacccgccucaaagccgccgcccaacccuccgccccccccaccgaagccauccaaaacaccacccccccccccuacacccccuaa

SEQ ID NO: 4808 - RNA, 300 nt, Artificial Sequence
  derived and/or modified CDS sequence (opt11) from Lassa virus__AIT17784__Z
augggcaaccgccaaaccaaacccaccaaagucgacgaacaccaacgcgcacaccucguccccgacgccucccaccucggcccccaauucugcaaauccugcugguucgaaaacaaaggccucgucgaaugcaacaaccacuaccucugccucaacugccuaucccuccuccucuccgucuccucccgcugccccaucugcaaaaugccccuccccaccaaacucaaagccaccgcccaacccuccgcccccucaaccgaagccgcccaaaacaccgcccccccccccuacgcccccuaa

SEQ ID NO: 4809 - RNA, 300 nt, Artificial Sequence
  derived and/or modified CDS sequence (opt11) from Lassa virus__AIT17788__Z
augggcaaccgccaagucaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccacccaacccuccgccccccccaccgaagccacccaaaaaaccacccccccccccuacacccccuaa

SEQ ID NO: 4810 - RNA, 300 nt, Artificial Sequence
  derived and/or modified CDS sequence (opt11) from Lassa virus__AIT17792__Z
augggcaacaaacaagccaaauccaccaaagucgacgaacaccaacgcgcccaccucguccccgacgccucccaccucggcccccaauucugcaaauccugcugguucgaaaaccgcggccucgucgaaugcaacaaccacuaccucugccucaacugccucucccuccuccucuccgucuccggccgcugccccaucugcaaaaugccccuccccaccaaacucaaagccaccgcccaacccuccgcccccuccaccgaagccacccaaaacaccacccccccccccuacacccccuaa

SEQ ID NO: 4811 - RNA, 300 nt, Artificial Sequence
  derived and/or modified CDS sequence (opt11) from Lassa virus__AIT17796__Z
augggcaacaaacaagccaaauccaccaaagucgacgaacaccaacgcgcccaccucguccccgacgccucccaccuaggcccccaauucugcaaauccugcugguucgaaaaccgcggccucgucgaaugcaacaaccacuaccucugccucaacugccucucccuccuccucuccgucuccucccgcugccccaucugcaaaaugccccuccccaccaaacucaaagccgccgcccaacccuccgcccccuccaccgaagccauccaaaacaccacccccccccccuacacccccuaa

SEQ ID NO: 4812 - RNA, 300 nt, Artificial Sequence
  derived and/or modified CDS sequence (opt11) from Lassa virus__AIT17800__Z
augggcaacaaacaagccaaagcccccgaagccaaagacucaccccgcgcaucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccacccccaccgccccccccaccgaagccgccgacuccauccgccccccccccuaccaccccuaa

SEQ ID NO: 4813 - RNA, 300 nt, Artificial Sequence
  derived and/or modified CDS sequence (opt11) from Lassa virus__AIT17804__Z
augggcaacaaacaagccaaagccuccgaagaaaaaaacuccccccgcgccucccucauccccgacgccacccaccucggcccccaauucugcaaaucaugcugguucgaaaacaaaggccucgucgaaugcaacaaccacuaccucugccucaacugccucacccuccuccucuccgucuccaaccgcugccccaucugcaaaaugccccuccccaccaaacuccgccccuccaccacccccaccgccccccccaccggcgccgccgacuccauccgccccccccccuacucccccuaa

SEQ ID NO: 4814 - RNA, 300 nt, Artificial Sequence
  derived and/or modified CDS sequence (opt11) from Lassa virus__AIT17808__Z
augggcaacaaacaagccaaagcccccgaauccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccacccgccuccgccccuccgccgcccccaccgccccccccaccggcgccgccgacuccacccgccccccccccuacucccccuaa

SEQ ID NO: 4815 - RNA, 303 nt, Artificial Sequence
  derived and/or modified CDS sequence (opt11) from Lassa virus__AIT17834__Z
augggcaacaaacaaacccgcuccccccccaaacccgaacacccccgccccacccuccuccccgacgccucccaccucggcccccaauucugcaaauccugcugguucgaaaacaaaggccucgucgaaugcaacaaccacuaccucugccucaacugccucacccuccuccucuccgucuccgaccgcugccccaucugcaaaaugccccuccccaccaaacucgccguccgcacccaacccuccgcccccccccucaaccaaggcaacacccaauccucccccccccccuacucccccuaa

SEQ ID NO: 4816 - RNA, 300 nt, Artificial Sequence
  derived and/or modified CDS sequence (opt11) from Lassa virus__AIT17838__Z
augggcaacaaacaagccaaaguccccgaauccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacucaaacccuccgccgcccccaccgccccccccaccggcgccgccgacuccauccgccccccccccuacucccccuaa

SEQ ID NO: 4817 - RNA, 300 nt, Artificial Sequence
  derived and/or modified CDS sequence (opt11) from Lassa virus__AIT17842__Z
augggcaacaaacaagccaaaguccccgaauccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccaccaaacuccgccccuccgccgcccccaccgccccccccaccggcgucgccgacuccauccgccccccccccuacucccccuaa

SEQ ID NO: 4818 - RNA, 300 nt, Artificial Sequence
  derived and/or modified CDS sequence (opt11) from Lassa virus__ANH09743__Z
augggcaacaaacaagccaaagccuccgaagucgaagacggcccccgcgccucccucauccccgacgccacccaccucggcccccaauucugcaaauccugcugguucgaaaacaaaucccucgucgaaugcaacaaccacuaccucugccucaacugccucacccuccuccucuccgucuccaaccgcugccccaucugcaaaaugccccuccccacccgccucaaaccauccgucguccccaccgcccccccaacccgcgccggcgacggcacccgccccccccccuacucccccuaa

SEQ ID NO: 4819 - RNA, 300 nt, Artificial Sequence
  derived and/or modified CDS sequence (opt11) from Lassa virus__ANH09745__Z
augggcaacaaacaaaccaaagcccccgaagucgaagacggcccccgcgccucccucauccccgacgccacccaccucggcccccaauucugcaaauccugcugguucgaaaacaaaggccucgucgaaugcaacaaccacuaccucugccucaacugccucacccuccuccucucagucuccucccgcugccccaucugcaaaaugccccuccccacccgccucaaacccuccaucguccccaccgccccccccgcccgcaccggcgaaaacacccgccccccccccuacucccccuaa

SEQ ID NO: 4820 - RNA, 300 nt, Artificial Sequence
  derived and/or modified CDS sequence (opt11) from Lassa virus__ANH09749__Z
augggcaacaaacaagccaaagcccccgaagucgaagacggcccccgcgccucccucauccccgacgccacccaccucggcccccaauucugcaaauccugcugguucgaaaaccgcggccuagucgaaugcaacaaccacuaccucugccucaacugccucacccuccuccucuccgucuccaaccgcugccccaucugcaaaaugccccuccccacccgccucaaacccuccgucguccccaccgccccccccaccggcgccggcggcgacacccgccccccccccuacucccccuaa

SEQ ID NO: 4821 - RNA, 300 nt, Artificial Sequence
  derived and/or modified CDS sequence (opt11) from Lassa virus__ANH09751__Z
augggcaacaaacaagccaaagcccccaaagccgaagacggcccccgcgccucccucauccccgacgccacccaccucggcccccaauucugcaaauccugcugguucgaaaacaaaggccucgucgaaugcaacaaccacuaccucugccucaacugccucacccuccuccucuccgucuccaaccgcugccccaucugcaaaaugccccuccccacccgccucaaacccuccgucguccccaccgccccccccaccggcgccggcggcgacacccgaccacccccccacucccccuaa

SEQ ID NO: 4822 - RNA, 300 nt, Artificial Sequence
  derived and/or modified CDS sequence (opt11) from Lassa virus__ANH09753__Z
augggcaacaaacaagccaaagccuccgaagccgaagacggcccccgcgccucccucauccccgacgccacccaccucggcccccaauucugcaaauccugcugguucgaaaacaaaggccucgucgaaugcaacaaccacuaccucugccucaacugccucacccuccuccucuccgucuccucccgcugccccaucugcaaaaugccccuccccacccgccuccgccccuccgucguccccaccgcccccuccgccggagccggcgacggcacccgccccccccccuacuccccauaa

SEQ ID NO: 4823 - RNA, 300 nt, Artificial Sequence
  derived and/or modified CDS sequence (opt11) from Lassa virus__ANH09755__Z
augggcaacaaacaaaccaaaaccaucaaaaaaaccgacuccccccgcgccucccucauccccgacgccucccacaugggcccccaauucugcaaauccugcugguucgaaaaccgcggccucgucgaaugcaacaaccacuaccucugccucaacugccucucccuccuccucuccgucuccaaccgcugccccaucugcaaaaugccccuccccaccaaacuccgcgccucccccucccccaccgcccccuccauccgagaagccaacaucaccaaccccccccccuacucccccuaa

SEQ ID NO: 4824 - RNA, 300 nt, Artificial Sequence
  derived and/or modified CDS sequence (opt11) from Lassa virus__ANH09759__Z
augggcaacaaacaaaccaaaaccaccaaaaaaaccgacuccccccgcgccucccucauccccgacgccucacacaugggcccccaauucugcaaauccugcugguucgaaaaccgcggccucgucgaaugcaacaaccacuaccucugccucaacugccucucccuccuccucuccgucuccaaccgcugccccaucugcaaaaugccccuccccaccaaacuccgcgccucccccucccccaccgcccccuccauccgcgaagccaacaucaccaaccccccccccuacucccccuaa

SEQ ID NO: 4825 - RNA, 300 nt, Artificial Sequence
  derived and/or modified CDS sequence (opt11) from Lassa virus__ANH09761__Z
augggcaacaaaggcaccaaacccacccaaaacuccgaacccucacgcgccaaccucguccccgacgccuccuaccucggcccccaauucugcaaaucaugcugguucgaaaacaaaggccucgucgaaugcaacaaccacuaccuaugccucaacugccucaccaugcuccucuccgucuccaaccgcugccccaucugcaaaaugccccuccccacaaaaaucaaagccuccggcucccccuccgccccccccaccgaagccaacuccgccgucucccccccccccuacacccccuaa

SEQ ID NO: 4826 - RNA, 300 nt, Artificial Sequence
  derived and/or modified CDS sequence (opt11) from Lassa virus__AMR44579__Z
augggcgcccgccaaaccaaacaaccccaaaucgaaggcuccccccgcgccucacucguccccgacgccucccaccucggcccccaauucugcaaauccugcugguucgaaaacaaaggccucgucgaaugcaacaaccacuaccucugccucaacugccucucccuccuccucuccgucuccaaccgcugccccaucugcaaaaugccccuccccaccaaacuccgcgucuccuccgcccccuccgccccccccgccgccaccgcccaacccggcacccccccccccuacucccccuaa

SEQ ID NO: 4827 - RNA, 300 nt, Artificial Sequence
  derived and/or modified CDS sequence (opt11) from Lassa virus__AMZ00378__Z
augggcaaccgccaaaccaaagccaccgaagccaaagacuccccccgcgccucccucauccccgacgccacccaccucggcccccaauucugcaaauccugcugguucgaaaacaaaggccucgucgaaugcaacaaccacuaccucugccucaacugccucacccuccuccucuccgucucaucccgcugccccaucugcaaaaugccccuccccacccgccucaaauccuccaccaaccccaccgcccccuccgccaaaaccgaaucaucaaucaaccccccccccuacucccccuaa

SEQ ID NO: 4828 - RNA, 1690 nt, Artificial Sequence
  mRNA product Design1 comprising derived and/or modified sequence from Lassa virus__AAF86703__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugaucuccuuccuccugcugugcggccgcagcugcuccgugacguacaaggggguguacgagcuccagacccuggagcugaacauggccaaccucaacaugaccaugccgcugagcugcaccaagaacaacucccaccacuacaucauggucggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcgugcaguacaaccucucccacagcuucgcgguggacgccgccaaccacugcgggaccaucgccaacggcguccugcagaccuucaugcggauggcguggggcggguccuacaucgcccuggacagcggcaaggggaacugggacugcaucaugaccuccuaccaguaccucaucauccagaacacgaccugggaggaccacugccaguucagccgccccucccccaucggcuaccuggggcugcucagccagcggacccgcgacaucuacaucagccggcgccugcugggcaccuucacguggacccucuccgacagcgagggcaacgaggcccccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccaucaagcggcucaagacggaggcccagauguccauccagcugaucaacaaggccgugaacgcccugaucaacgaccagcucaucaugaagaaccaccuccgcgacaucaugggcauccccuacugcaacuacagccgguacugguaccugaaccacaccgucaccgggaagaccucccugccccgcugcuggcuggugagcaacggcuccuaccugaacgagacgcacuucagcgacgacaucgagcagcaggcggacaacaugaucaccgagaugcuccagaaggaguacauggaccggcagggcaagaccccgcuggggcugguggaccucuucgucuucuccaccagcuucuaccugaucuccaucuuccugcaccuggugaagaucccgacgcaccgccacaucgugggcaagcccugccccaagccccaccggcucaaccacauggggaucugcagcugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4829 - RNA, 1693 nt, Artificial Sequence
  mRNA product Design1 comprising derived and/or modified sequence from Lassa virus__AAG41802__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcugaucacguuccuccugcugugcggccgcuccugcagcuccaaccucuacaaggggguguacgagcugcagagccuggaccucaacauggagacccugaacaugaccaugccgcuguccugcaccaagaacaacagccaccacuacauccgggucggcaacgacacgggccucgagcugacccugaccaacaccuccauccucaaccacaaguucugcaaccugagcgacgcccacaagaaggaccuguacgaccacgcccucauguccaucaucagcacguuccaccuguccauccccaacuucaaccaguacgaggccaugagcugcgacuucaacgggggcaagaucuccgugcaguacaaccugagccacuccuacgccaucgacgcggccaaccacugcgggaccguggccaacggcauccuccagaccuucaugcgcauggccuggggcgggagcuacaucgcgcuggacuccggccgggggaacugggacugcaucaugaccagcuaccaguaccugaucauccagaacacgaccugggagaaccacugccaguucucccgccccagccccaucggcuaccucgggcugcugagccagcggacccgcgacaucuacaucucccggcgccuccugggcaccuucacguggacccugagcgacuccgagggcaacgccacccccgggggcuacugccucacccgguggaugcugaucgaggccgagcugaagugcuucgggaacacggccgucgccaagugcaacgagaagcacgacgaggaguucugcgacaugcuccgccuguucgacuucaacaagcaggcgaucagccggcugaaguccgaggcccagaugagcauccagcucaucaacaaggccgugaacgcccugaucaacgaccagcugaucaugaagaaccaccuccgcgacaucaugggcauccccuacugcaacuacuccaaguacugguaccugaaccacaccaucaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcagggcaagaccccgcucgggcuggucgaccuguucguguucagcaccuccuucuaccugaucagcaucuuccuccgccuggugaagaucccgacgcaccggcacaucgucggcaagcccugccccaagccccaccgccugaaccacauggggaucugcuccugcggccucuacaagcagccgggggugcccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4830 - RNA, 1690 nt, Artificial Sequence
  mRNA product Design1 comprising derived and/or modified sequence from Lassa virus__AAL13212__GPC (opt1)
gggagaaagcuuaccaugggccagaucgugaccuucuuccaggaggucccccacgugaucgaggagaucaugaacaucgugcugaucacccucagccugcuggccauccucaagggggucuacaaccuggccacgugcggccugaucgggcucaucaccuuccuguuccugugcggccgcuccugcagcaugaccuacaagggguccuaccagcucgagacccuggagcugaacauggagacgcucaacaugaccaugccgcugagcugcaccaagaacaccucccaccacuacauccgggugggcaacgagacgggccuggagcucacccugaccaacaccagcaucaucaaccacaaguucugcaaccuguccgacgcgcacaagaagaaccucuacgaccacagccugauguccaucaucagcacguuccaccuguccauccccaacuucaaccaguacgaggccaugagcugcgacuucaacgggggcaagaucuccauccaguacaaccucagccacaccuacgccggggacgccgccaagcacugcggcacccuggcgaacgggauccugcagaccuucaugcgcauggccuggggcggcuccuacaucgcccucgacagcgggcggggcaacugggacugcaucaugacguccuaccaguaccugaucauccagaacaccaccugggaggaccacugccaguucagccgccccucccccaucggguaccugggccuccugagccagcggacccgcgagaucuacaucagccggcgccugcucggcacguucaccuggacccuguccgacagcgaggggaacgagaacccgggcggguacugccugacccgguggaugcucaucgaggccgagcugaagugcuucggcaacacggcgguggccaagugcaacgagaagcacgacgaggaguucugcgacaugcugcgccucuucgacuucaacaagcaggccauccagcggcugaaggccgaggcccagauguccauccagcugaucaacaaggcggucaacgcccucaucaacgaccagcugaucaugaagaaccaccuccgcgacaucauggggauccccuacugcaacuacagcaaguacugguaccugaaccacaccaccaccggccggacgucccugccccgcugcuggcuggugagcaacggcuccuaccucaacgagacccgguucagcgacgacaucgagcagcaggccgacaacaugaucaccgagaugcugcagaaggaguacaucgaccgccaggggaagacgccccugggccucguggaccuguucgucuucuccaccagcuucuaccugaucuccaucuuccugcaccucaucaagaucccgacccaccggcacaucgucgggggccccugccccaagccccaccgccugaaccacaaggggaucugcagcugcggccuguacaagcggccgggcguguccgugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4831 - RNA, 1693 nt, Artificial Sequence
  mRNA product Design1 comprising derived and/or modified sequence from Lassa virus__AAO59512__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucgccuuccuccugcugugcggccgcuccugcacgagcucccucuacaaggggguguacgagcugcagacccuggagcucaacauggagacccugaacaugaccaugccgcugagcugcacgaagaacaacucccaccacuacauccgggugggcaacgagaccggccucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgguggacgccgccaagcacugcgggaccguggccaacggcguccugcagaccuucaugcgcauggcguggggcggguccuacaucgcccucgacagcggccacgggcggugggacugcaucaugacguccuaccaguaccugaucauccagaacaccaccugggaggaccacugccaguucagccgccccucccccaucggcuaccuggggcuccugagccagcggacccgcgacaucuacaucagccggcgccugcucggcacguucaccuggacccuguccgacagcgagggcaaggacacccccgggggcuacugccugacgcgguggaugcucaucgaggccgagcugaagugcuucgggaacaccgccguggccaagugcaacgagaagcacgacgaggaguucugcgacaugcugcgccucuucgacuucaacaagcaggcgauccagcggcugaagaccgaggcccagauguccauccagcugaucaacaaggccgugaacgcccucaucaacgaccagcugaucaugaagaaccaccuccgcgacaucaugggcauccccuacugcaacuacagccgguacugguaccugaaccacaccacgaccgggaagaccucccugcccaagugcuggcuggucagcaacggcuccuaccucaacgagacccgcuucagcgacgacaucgagcagcaggccgacaacaugaucacggagaugcugcagaaggaguacauggagcggcagggcaagaccccgcuggggcucguggaccuguucguguucuccaccagcuucuaccugaucuccaucuuccugcaccucgucaagaucccgacccaccgccacaucgugggcaagagcugccccaagccccaccggcugaaccacauggggaucugcuccugcggccuguacaagcagcccggggugccggucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4832 - RNA, 1693 nt, Artificial Sequence
  mRNA product Design1 comprising derived and/or modified sequence from Lassa virus__AAT49000__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccucuuccugugcggccgcuccugcagcaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacacccugaugagcaucaucuccaccuuccaccugagcauccccaacuucaaccaguacgaggccauguccugcgacuucaacgggggcaagaucagcguccaguacaaccucucccacagcuacgccguggacgccgcgaaccacugcgggacgguggccaacggcguccugcagaccuucaugcggauggccuggggcggguccuacaucgcccuggacagcggccgcgggaacugggacugcaucaugaccuccuaccaguaccucgugauccagaacaccacgugggaggaccacugccaguucagccggcccucccccaucggcuaccuggggcugcucagccagcgcacccgggacaucuacaucagccgccggcugcugggcaccuucaccuggacgcucuccgacagcgagggcaaggacacccccgggggcuacugccugacccgcuggaugcugaucgaggcggagcucaagugcuucgggaacaccgccguggccaagugcaacgagaagcacgacgaggaguucugcgacaugcugcggcuguucgacuucaacaagcaggccauccagcgccucaaggccgaggcgcagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugcccaagugcuggcuggugagcaacggcuccuaccugaacgagacccacuucagcgacgacaucgagcagcaggccgacaaccucaucacggagaugcugcagaaggaguacauggagcgccagggcaagaccccgcuggggcucgucgaccuguucguguucuccaccagcuucuaccugaucuccaucuuccugcaccucgugaagaucccgacccaccggcacaucgucggcaagcccugccccaagccccaccgccugaaccacauggggaucugcagcugcggcguguacaagcagccgggggugcccguccgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4833 - RNA, 1693 nt, Artificial Sequence
  mRNA product Design1 comprising derived and/or modified sequence from Lassa virus__AAT49004__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4834 - RNA, 1693 nt, Artificial Sequence
  mRNA product Design1 comprising derived and/or modified sequence from Lassa virus__AAT49008__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccucuuccugugcggccgcuccugcagcaccacccuguacaaggggguguacgagcuccagacccuggagcugaacauggagacgcucaacaugaccaugccgcuguccugcaccaagaacaacagccaccacuacaucauggugggcaacgagaccggccuggagcucacgcugaccaacaccuccaucaucaaccacaaguucugcaaccugagcgacgcccacaagaagaaccucuacgaccacacccugauguccaucaucagcacguuccaccuguccauccccaacuucaaccaguacgaggccaugagcugcgacuucaacgggggcaagaucuccguccaguacaaccucagccacuccuacgccguggacgccgcgaaccacugcgggaccguggccaacggcguccugcagaccuucaugcggauggccuggggcgggagcuacaucgcccuggacuccggccgcgggaacugggacugcaucaugaccagcuaccaguaccucaucauccagaacacgaccugggaggaccacugccaguucucccggcccagccccaucggcuaccuggggcugcucucccagcgcacccgggacaucuacaucagccgccggcugcugggcaccuucacguggacccucagcgacuccgagggcaaggacacccccgggggcuacugccugacccgcuggaugcugaucgaggcggagcucaagugcuucgggaacacggccguggccaagugcaacgagaagcacgacgaggaguucugcgacaugcugcggcuguucgacuucaacaagcaggccauccagcgccucaaggccgaggcgcagaugagcauccagcugaucaacaaggccgugaacgcccugaucaacgaccagcucaucaugaagaaccaccuccgggacaucaugggcauccccuacugcaacuacucccgcuacugguaccugaaccacaccgucaccgggaagaccagccugcccaagugcuggcugguguccaacggcagcuaccugaacgagacgcacuucuccgacgacaucgagcagcaggccgacaaccucaucaccgagaugcugcagaaggaguacauggagcggcagggcaagaccccgcuggggcucguggaccuguucgucuucagcaccuccuucuaccugaucagcaucuuccugcaccucgugaagaucccgacgcaccgccacaucgugggcaagcccugccccaagccccaccggcugaaccacauggggaucugcuccugcggcgucuacaagcagccgggggugcccgugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4835 - RNA, 1690 nt, Artificial Sequence
  mRNA product Design1 comprising derived and/or modified sequence from Lassa virus__AAT49010__GPC (opt1)
gggagaaagcuuaccaugggccagaucgugaccuucuuccaggaggucccccacgugaucgaggaggugaugaacaucguccugaucgcccucagcgugcuggccauccugaaggggcucuacaacuucgcgaccugcggccugaucgggcuggugacguuccuccugcuguccggccgcagcugcuccaugaucuacaagggggucuacgagcuccagacccuggagcugaacauggagacccucaacaugaccaugccgcugagcugcacgaagaacaccucccaccacuacauccgggugggcaacgacaccggccuggagcucacccugacgaacgagacccugcuccaccacaaguucugcaaccugagcgacgcccacaagcgcaaccuguacgaccacgcccucauguccaucaucagcaccuuccaccuguccauccccaacuucaaccaguacgaggccaugagcugcgacuucaacgggggcaagaucaccgugcaguacaaccugucccacagcuacgccgucgacgcggccaagcacugcgggacgguggccaacggcgugcuccagaccuucaugcggauggccuggggcggguccuacaucgcgcuggacagccgccacggcaacugggacugcaucaugaccuccuaccaguaccugaucauccagaacaccacgugggaggaccacugccaguucagccggcccucccccaucggguaccucggccugcugagccagcgcacccgggacaucuacaucucccgccggcuccuggggaccuucaccuggacgcugagcgacagcgagggcaacgagaccccgggcggguacugccucacccgcuggaugcugaucgaggccgagcugaagugcuucggcaacaccgccgucgccaagugcaacgagaagcacgacgaggaguucugcgacaugcuccggcuguucgacuucaacaagcaggccauccgccggcugaagacggaggcgcagauguccauccagcucaucaacaaggccgugaacgcccugaucaacgaccagcugaucaugaagaaccaccuccgcgacaucauggggauccccuacugcaacuacagcaaguacugguaccugaaccacaccuccaccggcaagaccagccugccccggugcuggcucguguccaacgggagcuaccugaacgagacgcacuucuccgacgacaucgagcagcaggccgacaacaugaucaccgagaugcugcagaaggaguaccucgaccgccagggcaagacgccccugggccuggucgaccuguucguguucagcaccuccuucuaccucaucagcaucuuccugcaccugaucaagaucccgacccaccggcacaucguggggaagcccugccccaagccccaccgccucaaccacaugggcaucugcuccugcgggcuguacaagcagccgggcguccccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4836 - RNA, 1690 nt, Artificial Sequence
  mRNA product Design1 comprising derived and/or modified sequence from Lassa virus__AAT49014__GPC (opt1)
gggagaaagcuuaccaugggccagaucaucaccuucuuccaggaggugccccacgucaucgaggaggugaugaacaucgugcugaucgcccucagccugcuggccauccucaaggggcuguacaacaucgcgaccugcggcaucaucgggcuggucgccuuccucuuccugugcggcaaguccugcagccugacgcucaagggcggguacgagcugcagacccuggagcucaacauggagacccugaacaugaccaugccgcuguccugcacgaagaacagcucccaccacuacauccgcgugggcaacgagaccgggcucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacggcgggaagaucagcgugcaguacaaccugucccacagcuacgcgggcgacgccgccgagcacugcgggaccgucgccaacggcgugcugcagaccuucaugcggauggcguggggcgggcgcuacaucgcccucgacuccggcaaggggaacugggacugcaucaugacgagcuaccaguaccugaucauccagaacaccaccugggaggaccacugccaguucucccggcccagccccaucggcuaccugggccuccugucccagcgcacccgggacaucuacaucagccgccggcugcucgggacguucaccuggacccugagcgacuccgagggcaacgagacccccgggggcuacugccugacgcgcuggaugcucaucgaggccgagcugaagugcuucgggaacaccgccguggccaagugcaacgagaagcacgacgaggaguucugcgacaugcugcggcuguucgacuucaacaagcaggcgauccgccggcugaaggccgaggcccagaugagcauccagcugaucaacaaggccgucaacgcccucaucaacgaccagcugaucaugaagaaccaccuccgcgacaucaugggcauccccuacugcaacuacuccaaguacugguaccucaaccacaccagcuccggccggaccagccugcccaagugcuggcugaucuccaacgggagcuaccucaacgagacgcaguucuccgacgacaucgagcagcaggcggaccacaugaucaccgagaugcugcagaaggaguacaucgagcgccagggcaagaccccgcuggggcucguggacaucuucaucuucagcaccuccuucuaccugaucagcaucuuccugcaccugaucaagaucccgacgcaccggcacaucgugggcaagcccugccccaagccccaccgccucaaccacaugggggucugcuccugcggccuguacaagcacccgggcgugcccaccaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4837 - RNA, 1693 nt, Artificial Sequence
  mRNA product Design1 comprising derived and/or modified sequence from Lassa virus__AAV54104__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgagggggaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4838 - RNA, 1693 nt, Artificial Sequence
  mRNA product Design1 comprising derived and/or modified sequence from Lassa virus__ADI39451__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacgucgcgaccugcggccugaucgggcugaucgccuuccuccugcugugcggccgcuccugcacgaccacccucuacaaggggguguacgagcugcaggcccuggagcucaacauggagacccugaacaugacgaugccgcugagcugcaccaagaacaacucccaccacuacaucauggugggcaacgagaccggccucgagcugacccugacgaacaccagcaucaucaaccacaaguucugcaaccucuccgacgcccacaagaagaaccuguacgaccacgcccugaugagcaucaucuccaccuuccaccucagcauccccaacuucaaccaguacgaggcgauguccugcgacuucaacgggggcaagaucagcguccaguacaaccugucccacaccuacgccguggacgccgccaaccacugcgggacgguggcgaacggcguccugcagaccuucaugcggauggccuggggcgggagcuacaucgcccucgacuccggccgcgggagcugggacugcaucaugaccuccuaccaguaccugaucauccagaacaccacgugggaggaccacugccaguucagccggcccucccccaucggcuaccuggggcuccugagccagcgcacccgggacaucuacaucucccgccggcugcucggcaccuucaccuggacgcugagcgacagcgagggcaaggacacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgccugaaggccgaggcccagauguccauccagcugaucaacaaggccgugaacgcgcucaucaacgaccagcugaucaugaagaaccaccuccgggacaucaugggcauccccuacugcaacuacagcaaguacugguaccucaaccacacgaucaccgggcgcaccucccugcccaagugcuggcuggucagcaacggcuccuaccucaacgagacccacuucagcgacgacaucgagcagcaggccgacaacaugaucacggagaugcugcagaaggaguacaucgagcggcagggcaagaccccgcuggggcucguggaccuguucguguucuccaccagcuucuaccugaucuccaucuuccugcaccucaucaagaucccgacccaccgccacaucgucaacaagcccugccccaagccccaccggcugaaccacaugggcgugugcagcugcgggcuguacaagcagccgggcgugcccguccgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4839 - RNA, 1690 nt, Artificial Sequence
  mRNA product Design1 comprising derived and/or modified sequence from Lassa virus__ADU56610__GPC (opt1)
gggagaaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugaucuccuuccuccugcugugcggccgcagcugcuccacgaccuacaaggggguguacgagcuccagacccuggagcuggacauggccaaccucaacaugaccaugccgcugagcugcacgaagaacuccagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaaggggaacugggacugcaucaugacguccuaccaguaccucaucauccagaacaccaccugggaggaccacugccaguucagccgccccucccccaucggcuaccuggggcugcucagccagcggacccgcgacaucuacaucagccggcgccugcugggcacguucaccuggacccucuccgacagcgagggcaacgaggcccccgggggcuacugccugacccgguggaugcugaucgaggccgagcucaagugcuucgggaacacggcgaucgccaagugcaacgagaagcacgacgaggaguucugcgacaugcugcgccuguucgacuucaacaagcaggccaucaagcggcucaaggccgaggcccagauguccauccagcugaucaacaaggcggugaacgcccugaucaacgaccagcucaucaugaagaaccaccuccgcgacaucaugggcauccccuacugcaacuacagcaaguacugguaccugaaccacaccgugaccgggaagaccucccugccccggugcuggcugaucagcaacggcuccuaccugaacgagacgcacuucagcgacgacaucgagcagcaggccgacaacaugaucaccgagcuccugcagaaggaguacauggaccgccagggcaagaccccgcuggggcucgucgaccuguucguguucuccaccagcuucuaccugaucuccaucuuccugcaccucgugaagaucccgacgcaccggcacaucgucggccgccccugccccaagccccaccggcugaaccacauggggaucugcagcugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4840 - RNA, 1690 nt, Artificial Sequence
  mRNA product Design1 comprising derived and/or modified sequence from Lassa virus__ADU56618__GPC (opt1)
gggagaaagcuuaccaugggccagaucgugaccuucuuccaggaggucccccacgugaucgaggaggugaugaacaucguccugaucgcccucagcauccuggccauccugaaggggcucuacaacaucgcgaccugcggccugaucgggcuggugacguuccuccugcuguccggccgcagcugcuccaugaccuacaaggggguguacgagcuccagacccuggagcugaacaugaacacccucaacaugacgaugccgcugagcugcaccaagaacaacucccaccacuacaucauggucggcaacgagaccggccuggagcucacccugacgaacaccagccugcuccaccacaaguucugcaaccuguccgacgcccacaagaagaaccuguacgaccacacccucaugagcaucaucuccaccuuccaccugagcauccccaacuucaaccaguacgaggccauguccugcgacuucaacgggggcaagaucacggugcaguacaaccugagccacuccuacgccaucgacgccgcgaaccacugcgggaccguggccaacggcguccuccagaccuucaugcggauggccuggggcgggagcuacaucgcccuggacuccggccgcgggaagugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgagacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccgccggcugaaggccgaggcgcagaugagcauccagcucaucaacaaggccgugaacgcccugaucaacgaccagcugaucaugaagaaccaccuccgcgacaucaugggcauccccuacugcaacuacuccaaguacugguaccugaaccacaccagcaccgggcggaccucccugccccgcugcuggcucgucagcaacggcuccuaccugaacgagacgcacuucagcgacgacaucgagcagcaggccgacaacaugaucaccgagaugcugcagaaggaguaccucgaccggcagggcaagaccccgcuggggcugguggaccuguucguguucuccaccagcuucuaccucaucuccaucuuccugcaccuggucaagaucccgacgcaccgccacaucgugggcaagcccugccccaagccccaccggcucaaccacauggggaucugcagcugcggccuguacaagcagccgggggugcccguccgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4841 - RNA, 1690 nt, Artificial Sequence
  mRNA product Design1 comprising derived and/or modified sequence from Lassa virus__ADU56622__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4842 - RNA, 1690 nt, Artificial Sequence
  mRNA product Design1 comprising derived and/or modified sequence from Lassa virus__ADU56626__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcugaacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccgucacggggaagaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4843 - RNA, 1690 nt, Artificial Sequence
  mRNA product Design1 comprising derived and/or modified sequence from Lassa virus__ADU56630__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugcgcaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4844 - RNA, 1693 nt, Artificial Sequence
  mRNA product Design1 comprising derived and/or modified sequence from Lassa virus__AFY05588__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggaccuguacaucagccgccggcuccugggcaccuucaccuggacgcugagcgacuccgagggggaggacaccccgggcggguacugccucacccgcuggaugcugaucgaggccgagcugaagugcuucggcaacaccgccguggccaagugcaacgagaagcacgacgaggaguucugcgacaugcuccggcuguucgacuucaacaagcaggccauccagcgccugaaggcggaggcccagaugagcauccagcucaucaacaaggccgugaacgcccugaucaacgaccagcugaucaugaagaaccaccuccgggacaucauggggauccccuacugcaacuacuccaaguacugguaccugaaccacacgaccaccggccgcaccagccugcccaagugcuggcucgucuccaacggcagcuaccugaacgagacgcacuucuccgacgacaucgagcagcaggccgacaacaugaucaccgagaugcugcagaaggaguacauggagcggcaggggaagacgccccucggccugguggaccuguucguguucagcaccuccuucuaccugaucagcaucuuccuccaccuggucaagaucccgacccaccgccacaucguggggaaguccugccccaagccccaccggcugaaccacaugggcaucugcagcugcgggcucuacaagcagcccggcgugccggucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4845 - RNA, 1693 nt, Artificial Sequence
  mRNA product Design1 comprising derived and/or modified sequence from Lassa virus__AFY05590__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacauguacaucagccgccggcugcucggcaccuucaccuggacgcugagcgacuccgagggggaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4846 - RNA, 1693 nt, Artificial Sequence
  mRNA product Design1 comprising derived and/or modified sequence from Lassa virus__AHC95553__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguucuuccuccugugcggccgcuccugcagcuccaaccuguacaagggggucuacgagcuccagagccuggaccugaacauggagacccucaacaugaccaugccgcuguccugcaccaagaacaacagccaccacuacauccgggugggcaacgagacgggccuggagcucacccugaccaacaccucccugcucgaccacaaguucugcaaccugagcgacgcccacaagaagaaccuguacgaccacgcccucauguccaucaucagcacguuccaccuguccauccccaacuucaaccaguacgaggccaugagcugcgacuucaacgggggcaagaucaccgugcaguacaaccugucccacagcuacgccggggacgcggcccgccacugcggcaccaucgccaacgggguccuccagaccuucaugcggauggccuggggcggcuccuacaucgcgcuggacagcgggcacggcaacugggacugcaucaugacguccuaccaguaccugaucauccagaacaccaccugggaggaccacugccaguucagccgccccucccccaucggguaccucagccugcugagccagcggacccgcgacaucuacaucucccggcgccuccugggcacguucaccuggacccugagcgacuccgagggcaacgccacccccgggggcuacugccucacgcgguggaugcugaucgaggccgagcugaagugcuucgggaacaccgccguggccaagugcaacgagaagcacgacgaggaguucugcgacaugcuccgccuguucgacuucaacaagcaggcgaucagccggcugcgcuccgaggcccagaugagcauccagcucaucaacaaggccgugaacgcccugaucaacgaccagcugaucaugaagaaccaccuccgggacaucaugggcauccccuacugcaacuacuccaaguacugguaccugaaccacaccgucaccgggcgcacgagccugcccaagugcuggcucguguccaacggcagcuaccugaacgagacccacuucuccgacgacaucgagcagcaggccgacaacaugaucaccgagaugcugcagaaggaguacauggaccggcagggcaagaccccgcucgggcugguggaccuguucgucuucagcacguccuucuaccugaucagcaucuuccuccaccuggugaagaucccgacccaccgccacaucgugggcaagcccugccccaagccccaccggcugaaccgcauggggaucugcuccugcggccucuacaagcagccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4847 - RNA, 1693 nt, Artificial Sequence
  mRNA product Design1 comprising derived and/or modified sequence from Lassa virus__AHC95555__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguuccuccugcugugcggccgcuccugcagcuccaaccucuacaagggggucuacgagcugcagagccuggaccucaacauggagacccugaacaugaccaugccgcuguccugcaccaagaacaacagccaccacuacauccgggccggcaacgagacgggccucgagcugacccugaccaacaccucccucaucaaccacaaguucugcaaccugagcgacgcccacaagaagaaccuguacgaccacacgcucauguccaucaucagcaccuuccaccuguccauccccaacuucaaccaguacgaggccaugagcugcgacuucaacgggggcaagaucuccgugcaguacaaccugagccacgccuacgcgaucgacgccgccgagcacugcgggaccguggccaacggcguccuccagaccuucaugcgcauggcguggggcggguccuacaucgcccuggacagcggccgggggaacugggacugcaucaugacguccuaccaguaccugaucauccagaacaccaccugggaggaccacugccaguucagccgccccucccccaucggcuaccucgggcugcugagccagcggacccgcgacaucuacaucagccggcgccuccugggcacguucaccuggacccuguccgacagcgagggcaacgccacccccgggggcuacugccucacgcgguggaugcugaucgaggccgagcugaagugcuucgggaacaccgccguggcgaagugcaacgagaagcacgacgaggaguucugcgacaugcuccgccuguucgacuucaacaagcaggccaucucccggcucaagagcgaggcccagauguccauccagcugaucaacaaggccgugaacgcccugaucaacgaccagcugaucaugaagaaccaccuccgcgacaucaugggcauccccuacugcaacuacagcaaguacugguaccugaaccacaccaucaccgggcggacgucccugcccaagugcuggcucgucagcaacggcuccuaccugaacgagacccacuucagcgacgacaucgagcagcaggcggacaacaugaucaccgagaugcugcagaaggaguacauggagcgccagggcaagaccccgcucgggcugguggaccuguucguguucuccacgagcuucuaccugaucuccaucuuccuccaccuggucaagaucccgacccaccggcacaucgugggcaagcccugccccaagccccaccgccugaaccacauggggaucugcagcugcggccucuacaagcagccgggggugccccugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4848 - RNA, 1693 nt, Artificial Sequence
  mRNA product Design1 comprising derived and/or modified sequence from Lassa virus__AHC95557__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguucuuccuccugugcggccgcuccugcagcuccaaccuguacaagggggucuacgagcuccagagccuggaccugaacauggagacccucaacaugaccaugccgcuguccugcaccaagaacaacagccaccacuacauccgggugggcaacgagacgggccuggagcucacccugaccaacaccucccugcucaaccacaaguucugcaaccugagcgacgcccacaagcgcaaccuguacgaccacgcccucauguccaucaucagcacguuccaccuguccauccccaacuucaaccaguacgaggccaugagcugcgacuucaacgggggcaagaucaccgugcaguacaaccugucccacagcuacgccggggacaccgcgaagcacugcggcaccaucgccaacgggguccuccagacguucaugcggauggccuggggcggcuccuacaucgcccuggacagcgggcacggcaacugggacugcaucaugaccuccuaccaguaccugaucauccagaacaccaccugggaggaccacugccaguucagccgccccucccccaucggguaccucggccugcugagccagcggacgcgcgacaucuacaucagccggcgccuccugggcaccuucaccuggacccuguccgacagcgaggggaacgcgacgccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccaucucccggcugcgcagcgaggcgcagauguccauccagcucaucaacaaggccgugaacgcccugaucaacgaccagcugaucaugaagaaccaccuccgggacaucauggggauccccuacugcaacuacagcaaguacugguaccugaaccacaccgucacgggccgcaccucccugcccaagugcuggcucgugagcaacggcuccuaccugaacgagacccacuucagcgacgacaucgagcagcaggccgacaacaugaucaccgagaugcugcagaaggaguacauggaccggcaggggaagacgccccucggccugguggaccuguucgucuucuccaccagcuucuaccugaucuccaucuuccuccaccuggugaagaucccgacccaccgccacaucguggggaagcccugccccaagccccaccggcugaaccgcaugggcaucugcagcugcgggcucuacaagcagccgggcguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4849 - RNA, 1693 nt, Artificial Sequence
  mRNA product Design1 comprising derived and/or modified sequence from Lassa virus__AHC95559__GPC (opt1)
gggagaaagcuuaccaugggccagaucaucaccuucuuccaggaggugccccacgucaucgaggaggugaugaacaucgugcugaucgcccucagcauccuggccguccugaaggggcucuacaacaucgcgaccugcggccugaucgggcuggugacguuccuccugcugugcggccgcuccugcagcuccagccucuacaaggggguguacgagcugcagucccuggaccucaacauggagacccugaacaugaccaugccgcugagcugcaccaagaacaacucccaccacuacauccgggucggcaacgagacgggccucgagcugacccugaccaacaccagccucaucaaccacaaguucugcaaccuguccgacgcccacaagaagaaccuguacgaccacgcccucaugagcaucaucuccacguuccaccugagcauccccaacuucaaccaguacgaggccauguccugcgacuucaacgggggcaagaucagcgugcaguacaaccugucccacgccuacgcgaucgacgccgccagccacugcgggaccguggccaacggcguccuccagaccuucaugcgcauggcguggggcggguccuacaucgcccuggacagcggccacgggaacugggacugcaucaugaccuccuaccaguaccugaucauccagaacacgaccugggaggaccacugccaguucagccggcccagccccaucggcuaccucgggcugcugucccagcgcacccgggacaucuacaucagccgccggcuccugggcaccuucacguggacccuguccgacagcgagggcaacgccacccccgggggcuacugccucacccgcuggaugcugaucgaggccgagcugaagugcuucgggaacacggccguggcgaagugcaacgagaagcacgacgaggaguucugcgacaugcuccggcuguucgacuucaacaagcaggccaucucccgccucaagagcgaggcccagauguccauccagcugaucaacaaggccgugaacgcccugaucaacgaccagcugaucaugaagaaccaccuccgggacaucaugggcauccccuacugcaacuacagcaaguacugguaccugaaccacaccgucaccgggaagaccucccugcccaagugcuggcucgugagcaacggcuccuaccugaacgagacgcacuucagcgacgacaucgagcagcaggcggacaacaugaucaccgagaugcugcagaaggaguacauggagcgccagggcaagaccccgcucgggcugguggaccuguucgucuucuccaccagcuucuaccugaucuccaucuuccuccaccuggugaagaucccgacgcaccggcacaucgugggcaagcccugccccaagccccaccgccugaaccacauggggaucugcagcugcggccucuacaagcagccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4850 - RNA, 1693 nt, Artificial Sequence
  mRNA product Design1 comprising derived and/or modified sequence from Lassa virus__AIT17126__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcugcucacguuccugcugcucugcggccgcuccugcaccaccgggcuguacaagggcgucuacgagcugcagacccucgagcugaacauggagacgcugaacaugaccaugccgcucagcugcaccaagaacaacucccaccacuacaucauggugggcaacgagaccgggcuggagcugacgcucaccaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacggcgggaagaucagcgugcaguacaaccugucccacagcuacgccggcgacgcggccgaccacugcgggacggucgccaacggcgugcuccagaccuucaugcggauggccuggggcggguccuacaucgcgcuggacagcggccgcgggcggugggacugcaucaugaccuccuaccaguaccugaucauccagaacaccacgugggaggaccacugccaguucagccgccccucccccaucggcuaccucggccugcugagccagcggacccgcgacaucuacaucucccggcgccuccuggggaccuucaccuggacgcugagcgacagcgagggcaaggacacccccgggggcuacugccucacccgguggaugcugaucgaggccgagcugaagugcuucgggaacaccgccguggccaagugcaacgagaagcacgacgaggaguucugcgacaugcuccgccuguucgacuucaacaagcaggccauccagcggcugaaggcggaggcccagauguccauccagcucaucaacaaggccgucaacgcccugaucaacgaccagcuggugaugaagaaccaccuccgcgacaucaugggcauccccuacugcaacuacagccgguacugguaccugaaccacacgaccaccggccgcaccucccugcccaagugcuggcucgugagcaacggguccuaccugaacgagacgcacuucagcgacgacaucgagcagcaggccgacaacaugaucaccgagaugcugcagaaggaguacauggagcggcagggcaagaccccgcucgggcuggucgaccuguucguguucuccaccagcuucuaccugaucuccaucuuccuccaccuggugaagaucccgacgcaccgccacaucgucggcaagagcugccccaagccccaccggcugaaccacauggggaucugcuccugcggccucuacaagcagcccggcgugccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4851 - RNA, 1693 nt, Artificial Sequence
  mRNA product Design1 comprising derived and/or modified sequence from Lassa virus__AIT17130__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggcuucguggggcuggucacguuccugcuccugugcggccgcuccugcaccaccagccuguacaaggggguguacgagcuccagacccuggagcugaacauggagacgcucaacaugaccaugccgcuguccugcaccaagaacaacagccaccacuacauccgggugggcaacgacaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccagccacugcgggacgaucgccaacggcgugcugcagaccuucaugcgcauggccuggggcggguccuacaucgcgcuggacagcggccgggaccgcugggacugcaucaugaccuccuaccaguaccucaucauccagaacaccacgugggaggaccacugccaguucagccggcccucccccaucggguaccugggccugcucagccagcgcacccgggacaucuacaucagccgccggcugcuggggaccuucaccuggacgcucuccgacagcgagggcaaggacaccccgggcggguacugccugacccgcuggaugcugaucgaggccgagcucaagugcuucggcaacaccgccgucgccaagugcaacgagaagcacgacgaggaguucugcgacaugcugcggcuguucgacuucaacaagcaggccauccagcgccucaaggcggaggcccagauguccauccagcugaucaacaaggccgugaacgcccugaucaacgaccagcucaucaugaagaaccaccuccgggacaucauggggauccccuacugcaacuacagcaaguacugguaccugaaccacacgaccaccggcaagaccucccugcccaagugcuggcuggugagcaacggguccuaccugaacgagacgcacuucagcgacgacaucgagcagcaggccgacaacaugaucaccgagaugcuccagaaggaguacauggagcgccagggcaagacgccccugggccuggucgaccucuucguguucuccaccagcuucuaccugaucuccaucuuccugcaccuggugaagaucccgacccaccggcacaucgucggcaagagcugccccaagccccaccgccucaaccacauggggaucugcuccugcgggcuguacaagcagcccggcgugccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4852 - RNA, 1693 nt, Artificial Sequence
  mRNA product Design1 comprising derived and/or modified sequence from Lassa virus__AIT17134__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcgggcuguacaagcagcccggcgugccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4853 - RNA, 1693 nt, Artificial Sequence
  mRNA product Design1 comprising derived and/or modified sequence from Lassa virus__AIT17138__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccucccugaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccagccacugcgggacgguggccaacggcguccugcagaccuucaugcggauggccuggggcggguccuacaucgcgcuggacagcggccgcgggggcugggacugcaucaugaccuccuaccaguaccucaucauccagaacaccacgugggaggaccacugccaguucagccggcccucccccaucggguaccugggccugcucagccagcgcacccgggacaucuacaucagccgccggcugcugggcaccuucaccuggacgcucuccgacagcgaggggaaggacaccccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggccauccagcgccucaaggcggaggcccagauguccauccagcugaucaacaaggccgugaacgcccugaucaacgaccagcucaucaugaagaaccaccuccgggacaucauggggauccccuacugcaacuacagcaaguacugguaccugaaccacacgaccaccggccgcaccucccugccccggugcuggcuggucagcaacggcuccuaccugaacgagacgcacuucagcgacgacaucgagcagcaggccgacaacaugaucaccgagaugcuccagaaggaguacauggagcgccaggggaagacgccccugggccugguggaccuguucguguucuccaccagcuucuaccucaucuccaucuuccugcaccuggucaagaucccgacccaccggcacaucgugggcaagagcugccccaagccccaccgccucaaccacauggggaucugcuccugcgggcuguacaagcagcccggcgugccggucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4854 - RNA, 1693 nt, Artificial Sequence
  mRNA product Design1 comprising derived and/or modified sequence from Lassa virus__AIT17142__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggcaucgucgggcuggugacguuccugcuccugugcggccgcuccugcaccaccagccuguacaaggggguguacgagcuccagacccuggagcugaacauggagacgcucaacaugaccaugccgcuguccugcaccaagaacaacagccaccacuacaucauggucggcaacgacaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacuccuacgccggggacgcggccgaccacugcggcacgguggccaacgggguccugcagaccuucaugcggauggccuggggcggcagcuacaucgcgcuggacuccgggcgcggccggugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugcccaagugcuggcuggucuccaacggcagcuaccugaacgagacgcacuucuccgacgacaucgagcagcaggccgacaacaugaucaccgagaugcuccagaaggaguacauggagcggcaggggaagacgccccugggccugguggaccucuucguguucagcaccuccuucuaccugaucagcaucuuccugcaccuggucaagaucccgacccaccgccacaucguggggaagcccugccccaagccccaccggcucaaccacaugggcaucugcuccugcgggcuguacaagcagccgggcgugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4855 - RNA, 1693 nt, Artificial Sequence
  mRNA product Design1 comprising derived and/or modified sequence from Lassa virus__AIT17146__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggccggugggacugcaucaugaccagcuaccaguaccugaucauccagaacaccacgugggaggaccacugcuccuucagccgccccucccccaucggguaccucggccugcugagccagcggacccgcgacaucuacaucagccggcgccuccugggcaccuucaccuggacgcuguccgacagcgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagauguccauccagcucaucaacaaggccgugaacgcccugaucaacgaccagcugaucaugaagaaccaccuccgcgacaucauggggauccccuacugcaacuacagcaaguacugguaccugaaccacacgaccaccggcaagaccucccugcccaagugcuggcucgugagcaacggcuccuaccugaacgagacgcacuucagcgacgacaucgagcagcaggccgacaacaugaucaccgagaugcugcagaaggaguacauggagcggcaggggaagacgccccucggccuggucgaccuguucguguucuccaccagcuucuaccugaucuccaucuuccuccaccuggugaagaucccgacccaccgccacaucgucggcaagagcugccccaagccccaccggcugaaccacauggggaucugcuccugcggguucuacaagcagcccggcgugccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4856 - RNA, 1693 nt, Artificial Sequence
  mRNA product Design1 comprising derived and/or modified sequence from Lassa virus__AIT17154__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggcaucguggggcuggucuccuuccugcuccugugcggccgcagcugcacgaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacagcuacgccggggacgcggccaaccacugcggcaccaucgccaacggggugcugcagacguucaugcggauggccuggggcggcuccuacaucgcgcuggacagcgggcgcgaccggugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaaggacacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccagcggcucaaggcggaggcccagauguccauccagcugaucaacaaggccgucaacgcccugaucaacgaccagcucaucaugaagaaccaccuccgcgacaucaugggcauccccuacugcaacuacagcaaguacugguaccugaaccacaccacgaccgggaagaccucccugcccaagugcuggcuggugagcaacggcuccuaccugaacgagacccacuucagcgacgacaucgagcagcaggccgacaacaugaucacggagaugcuccagaaggaguacauggagcggcagggcaagaccccgcuggggcugguggaccucuucgucuucuccaccagcuucuaccugaucuccaucuuccugcaccuggugaagaucccgacccaccgccacguggucggcaagagcugccccaagccccaccggcucaaccacauggggaucugcuccugcggccuguacgggcagcccggcgugccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4857 - RNA, 1693 nt, Artificial Sequence
  mRNA product Design1 comprising derived and/or modified sequence from Lassa virus__AIT17158__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaaguccugccccaagccccaccggcugaaccacauggggaucugcagcugcggccuguacaagcagcccggggugccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4858 - RNA, 1693 nt, Artificial Sequence
  mRNA product Design1 comprising derived and/or modified sequence from Lassa virus__AIT17164__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccagcucccucuacaaggggguguacgagcugcagacccuggagcucaacauggagacccugaacaugacgaugccgcugagcugcaccaagaacaacucccaccacuacauccgggugggcaacgagaccggccucgagcugacccugacgaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgccggggacgcggccaagcacugcggcaccguggccaacggggugcugcagacguucaugcgcauggccuggggcggcuccuacaucgcgcucgacagcgggcacggcaacugggacugcaucaugaccuccuaccaguaccugaucauccagaacaccaccugggaggaccacugccaguucagccggcccucccccaucggguaccugggccuccugagccagcgcacgcgggacaucuacaucagccgccggcugcucggcaccuucaccuggacccuguccgacagcgaggggaacgacgccccgggcggguacugccugacgcgcuggaugcucauccaggccgagcugaagugcuucggcaacaccgccgucgccaagugcaacgagaagcacgacgaggaguucugcgacaugcugcggcuguucgacuucaacaagcaggcgauccagcgccugaaggccgaggcccagauguccauccagcugaucaacaaggccgugaacgcccucaucaacgaccagcugaucaugaagaaccaccuccgggacaucauggggauccccuacugcaacuacagcaaguacugguaccucaaccacaccaccacgggccgcaccucccugccccggugcuggcuggugagcaacggcuccuaccucaacgagacccacuucagcgacgacaucgagcagcaggcggacaacaugaucaccgagaugcugcagaaggaguacauggagcgccaggggaagacgccccugggccucgucgaccuguucguguucuccaccagcuucuaccugaucuccaucuuccugcaccucgugaagaucccgacccaccggcacaucgucggcaagagcugccccaagccccaccgccugaaccacauggggaucugcuccugcgggcuguucaagcagcccggcgugccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4859 - RNA, 1693 nt, Artificial Sequence
  mRNA product Design1 comprising derived and/or modified sequence from Lassa virus__AIT17168__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcugcucaccuuccugcugcucugcggccgcuccugcaccgccagccgguacaagggggucuacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgcgggggacgccgccaaccacugcggcaccgucgccaacggggugcugcagacguucaugcgcauggcguggggcggcagcuacaucgcccucgacuccgggcacggcagcugggacugcaucaugaccuccuaccaguaccugaucauccagaacaccaccugggaggaccacugccaguucagccggcccucccccaucggguaccugggccuccugagccagcgcacgcgggacaucuacaucagccgccggcugcucggcaccuucaccuggacccuguccgacagcgaggggaaggacacgccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggcgauccagcgccugaaggccgaggcccagauguccauccagcugaucaacaaggccgucaacgcccucaucaacgaccagcugaucaugaagaaccaccuccgggacaucauggggauccccuacugcaacuacagcaaguacugguaccucaaccacaccacgaccggcaagaccucccugcccaagugcuggcuggugagcaacggcuccuaccucaacgagacccacuucagcgacgacaucgagcagcaggcggacaacaugaucacggagaugcugcagaaggaguacauggagcgccaggggaagacgccccugggccucguggaccuguucgucuucuccaccagcuucuaccugaucuccaucuuccugcaccucgugaagaucccgacccaccggcacaucgugggcaagagcugccccaagccccaccgccugaaccacauggggaucugcuccugcgggcuguacaagcagcccggcgucccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4860 - RNA, 1693 nt, Artificial Sequence
  mRNA product Design1 comprising derived and/or modified sequence from Lassa virus__AIT17172__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaagcccugcccccggccccaccgccugaaccacaugggcaucugcuccugcgggcuguacaagcagccgggcgugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4861 - RNA, 1693 nt, Artificial Sequence
  mRNA product Design1 comprising derived and/or modified sequence from Lassa virus__AIT17176__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucaucacguuccugcugcucugcggccgcuccugcaccaccaaccuguacaagggggucuacgagcugcaggcccucgagcugaacauggagacccugaacaugacgaugccgcucagcugcaccaagaacaacucccaccacuacaucauggugggcaacgagaccggccuggagcugacccucacgaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgggggccggaucagcgugcaguacaaccugucccacagcuacgcgggggacgccgccucccacugcggcaccaucgccaacgggguccuccagacguucaugcgcauggcguggggcggcagcuacaucgcccuggacuccgggcacggcgggugggacugcaucaugaccagcuaccaguaccugaucauccagaacaccaccugggaggaccacugccaguucucccggcccagccccaucggcuaccucggccugcugucccagcgcacgcgggacaucuacaucagccgccggcuccuggggaccuucaccuggacccugagcgacuccgagggcaaggacacgcccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggcgauccagcgccugaaggccgaggcccagaugagcauccagcucaucaacaaggccgugaacgcccugaucaacgaccagcugaucaugaagaaccaccuccgggacaucaugggcaucccguacugcaacuacuccaaguacugguaccugaaccacaccgucacgggcaagaccagccugcccaagugcuggcucguguccaacgggagcuaccugaacgagacccacuucuccgacgacaucgagcagcaggcggacaacaugaucaccgagaugcugcagaaggaguacauggagcgccagggcaagacgccccucgggcugguggaccuguucgucuucagcaccuccuucuaccugaucagcaucuuccuccaccuggugaagaucccgacccaccggcacguggucggcaagcccugccccaagccccaccgccugaaccacauggggaucugcuccugcggccucuacaagcagccgggcgugcccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4862 - RNA, 1693 nt, Artificial Sequence
  mRNA product Design1 comprising derived and/or modified sequence from Lassa virus__AIT17180__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcagacgcuggagcucaacauggagacccugaacaugaccaugccgcugagcugcaccaagaacaacucccaccacuacauccgggugggcaacgagacgggccucgagcugacccugaccaacaccagcaucaucaaccacaaguucugcaaccucuccgacgcccacaagaagaaccuguacgaccacgcccugaugagcaucaucuccacguuccaccucagcauccccaacuucaaccaguacgaggccauguccugcgacuucaacgggggcaagaucagcguccaguacaaccugucccacagcuacgccggggacgcggccaaccacugcggcaccguggccaacggggugcugcagaccuucaugcgcauggccuggggcggcuccuacaucgcgcucgacagcgggcggggcaacugggacugcaucaugaccuccuaccaguaccugaucauccagaacacgaccugggacgaccacugccaguucagccgccccucccccaucggguaccugggccuccugagccagcggacccgcgacgucuacaucucccggcgccugcucggcaccuucacguggacccugagcgacagcgaggggaaggacaccccgggcggguacugccugacccgguggaugcucaucgaggccgagcugaagugcuucggcaacacggccguggccaagugcaacgagaagcacgacgaggaguucugcgacaugcugcgccucuucgacuucaacaagcaggccauccagcggcugaaggcggaggcccagauguccauccagcugaucaacaaggccgugaacgcccucaucaacgaccagcugaucaugaagaaccaccuccgcgacaucauggggauccccuacugcaacuacagcaaguacugguaccugaacaacaccgccaccggcaagaccucccugcccaagugcuggcugaucagcaacggcuccuaccucaacgagacgcacuucagcgacgacaucgagcaggaggcggacaacaugaucaccgagaugcugcagaaggaguacauggagcggcaggggaagacgccccugggccucgucgaccuguucguguucuccaccagcuucuaccugaucuccaucuuccugcaccucgugaagaucccgacccaccgccacaucgucggcaagagcugccccaagccccaccggcugaaccacauggggaucugcuccugcgggcuguacaagcagcccggcgugccggugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4863 - RNA, 1693 nt, Artificial Sequence
  mRNA product Design1 comprising derived and/or modified sequence from Lassa virus__AIT17184__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucaccuuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgggggacgccgccaaccacugcggcacgguggccaacggggugcugcagaccuucaugcgcauggcguggggcggcuccuacaucgcccucgacagcgggcggaacggcugggacugcaucaugaccuccuaccaguaccugaucauccagaacaccacgugggacgaccacugccaguucagccgccccucccccaucggguaccugggccuccugagccagcggacccgcgacaucuacaucucccggcgccugcucggcaccuucaccuggacgcugagcgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggcgauccggcgccugaaggccgaggcccagauguccauccagcugaucaacaaggccgugaacgcccucaucaacgaccagcugaucaugaagaaccaccuccgggacaucauggggauccccuacugcaacuacagcaaguacugguaccugaacaacacggcgaccggcaagaccucccugccccgcugcuggcuggugagcaacggcuccuaccucaacgagacccacuucagcgacgacaucgagcagcaggccgacaacaugaucacggagaugcugcagcgggaguacauggagcgccaggggaagacgccccugggccucgucgaccuguucguguucuccaccagcuucuaccugaucuccaucuuccugcaccucgugaagaucccgacccaccggcacaucgucgggaagcccugccccaagccccaccgccugaaccacaugggcaucugcagcugcgggcuguacaagcagccgggcgugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4864 - RNA, 1693 nt, Artificial Sequence
  mRNA product Design1 comprising derived and/or modified sequence from Lassa virus__AIT17188__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggcuucguggggcuggucuccuuccugcuccugugcggccgcagcugcacgaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacagcuacgccguggacgcggccaaccacugcgggaccguggccaacggcguccugcagacguucaugcggauggccuggggcggguccuacaucgcgcuggacagcggccacggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaaggacacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccagcggcuccgcgcggaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccacgaccgggcgcaccagccugcccaagugcuggcuggucuccaacggcagcuaccugaacgagacccacuucuccgacgacaucgagcagcaggccgacaacaugaucacggagaugcuccagaaggaguacauggagcggcagggcaagaccccgcuggggcugguggaccucuucguguucagcaccuccuucuaccugaucagcaucuuccugcaccuggucaagaucccgacccaccgccacaucgugggcaaguccugccccaagccccaccggcucaaccacauggggaucugcagcugcggccuguacgggcagcccggcgugccggucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4865 - RNA, 1693 nt, Artificial Sequence
  mRNA product Design1 comprising derived and/or modified sequence from Lassa virus__AIT17192__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggcuucaucgggcugguguccuuccugcuccugugcggccgcagcugcacgaccucccuguacaagggggucuacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguucgaggccauguccugcgacuucaacgggggcaagaucagcgugcaguacaaccucucccacagcuacgccgucgacgcggccaaccacugcgggaccguggccaacggcgugcugcagacguucaugcggauggccuggggcggguccuacaucgcgcuggacagcggccacggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaaggacacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucaugggcauccccuacugcaacuacuccaaguacugguaccugaaccacaccacgaccgggcggaccagccugcccaagugcuggcugguguccaacggcagcuaccugaacgagacccacuucuccgacgacaucgagcagcaggccgacaacaugaucacggagaugcuccagaaggaguacauggagcgccagggcaagaccccgcuggggcuggucgaccucuucguguucagcaccuccuucuaccugaucagcaucuuccugcaccuggugaagaucccgacccaccggcacaucgucggcaaguccugccccaagccccaccgccucaaccacauggggaucugcagcugcggccuguacgggcagcccggcgugccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4866 - RNA, 1693 nt, Artificial Sequence
  mRNA product Design1 comprising derived and/or modified sequence from Lassa virus__AIT17196__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggccggugggacugcaucaugaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugaacauccagcucaucaacaaggccgugaacgcccugaucaacgaccagcugaucaugaagaaccaccuccgcgacaucauggggauccccuacugcaacuacagcaaguacugguaccugaaccacacgaccaccggcaagaccucccugccccggugcuggcucgugagcaacggcuccuaccugaacgagacgcacuucagcgacgacaucgagcagcaggccgacaacaugaucaccgagaugcugcagaaggaguacauggagcgccaggggaagacgccccucggccuggucgaccuguucguguucuccaccagcuucuaccugaucuccaucuuccuccaccuggugaagaucccgacccaccggcacaucgucgggaagcccugccccaagccccaccgccugaaccacaugggcaucugcagcugcggguucuacaagcagccgggcgugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4867 - RNA, 1693 nt, Artificial Sequence
  mRNA product Design1 comprising derived and/or modified sequence from Lassa virus__AIT17204__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccagcucccuguacaaggggguguacgagcugcagacccucgagcugaacauggagacccugaacaugacgaugccgcucagcugcaccaagaacuccagccaccacuacauccgggugggcaacgagaccggccuggagcugacccucacgaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcaccguggccaacggggugcuccagacguucaugcgcauggccuggggcggcagcuacaucgcgcuggacuccgggcacgaccggugggacugcaucaugaccagcuaccaguaccugaucauccagaacaccaccugggaggaccacugccaguucucccgccccagccccaucggcuaccucgggcugcugagccagcggacgcgcgacaucuacaucucccggcgccuccugggcaccuucaccuggacccugagcgacuccgagggcaaggacacgcccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcaucccguacugcaacuacuccaaguacugguaccugaaccacaccaucacggggaagaccagccugcccaagugcuggcucguguccaacggcagcuaccugaacaagacccacuucuccgacgacaucgagcagcaggccgacaacaugaucaccgagaugcugcagaaggaguacauggagcggcagggcaagacgccccucgggcuggucgaccuguucguguucagcaccuccuucuaccugaucagcaucuuccuccaccugaucaagaucccgacccaccgccacaucgugggcaagcccugccccaagccccaccggcugaaccacauggggaucugcuccugcggccucuacaagcagccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4868 - RNA, 1693 nt, Artificial Sequence
  mRNA product Design1 comprising derived and/or modified sequence from Lassa virus__AIT17208__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggccagugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4869 - RNA, 1693 nt, Artificial Sequence
  mRNA product Design1 comprising derived and/or modified sequence from Lassa virus__AIT17210__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcgaccggugggacugcaucaugaccagcuaccaguaccugaucauccagaacaccacgugggaggaccacugccaguucucccgccccagccccaucggcuaccucgggcugcugucccagcggacccgcgacaucuacaucagccggcgccuccugggcaccuucaccuggacgcugagcgacuccgagggcaaggacacccccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcauccccuacugcaacuacuccaaguacugguaccugaaccacacgaccaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcagggcaagaccccgcucgggcuggucgaccuguucguguucagcaccuccuucuaccugaucagcaucuuccuccgccuggugaagaucccgacgcaccggcacaucgucggcaagcccugccccaagccccaccgccugaaccacauggggaucugcuccugcggccucuacaagcagccgggggugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4870 - RNA, 1693 nt, Artificial Sequence
  mRNA product Design1 comprising derived and/or modified sequence from Lassa virus__AIT17212__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccaccggaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcgcauggccuggggcggcagcuacaucgcgcuggacuccgggcggggcaagugggacugcaucaugaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucauggggauccccuacugcaacuacuccaaguacugguaccugaaccacacgaccaccggcaagaccagccugccccggugcuggcucguguccaacggcagcuaccugaacgagacgcacuucuccgacgacaucgagcagcaggccgacaacaugaucaccgagaugcugcagaaggaguacauggagcgccaggggaagacgccccucggccuggucgaccuguucguguucagcaccuccuucuaccugaucagcaucuuccuccaccuggugaagaucccgacccaccggcacaucgucgggaagcccugccccaagccccaccgccugaaccacaugggcaucugcuccugcgggcucuacaagcagccgggcgugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4871 - RNA, 1693 nt, Artificial Sequence
  mRNA product Design1 comprising derived and/or modified sequence from Lassa virus__AIT17216__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggccgcugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugccccaagccccaccgccugaacuacaugggcaucugcuccugcgggcuguacaagcagccgggcgugcccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4872 - RNA, 1693 nt, Artificial Sequence
  mRNA product Design1 comprising derived and/or modified sequence from Lassa virus__AIT17224__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgacaccggccucgagcugacgcugaccaacaccagcaucauccagcacaaguucugcaaccucuccgacgcccacaagaagaaccuguacgaccacacccugaugagcaucaucuccacguuccaccucagcauccccaacuucaaccaguacgaggccauguccugcgacuucaacgggggcaagaucagcguccaguacaaccugucccacagcuacgccggggacgcggccucccacugcggcaccguggccaacggggugcugcagaccuucaugcgcauggccuggggcggcagcuacaucgcgcucgacuccgggcggggcaacugggacugcaucaugaccagcuaccaguaccugaucauccagaacacgaccugggaggaccacugccaguucucccgccccagccccaucggguaccugggccuccugucccagcggacccgcgacaucuacaucagccggcgccugcucggcaccuucacguggacccugagcgacuccgaggggcgggacaccccgggcggguacugccugacccgcuggaugcucaucgaggccgagcugaagugcuucggcaacacggccgucgccaagugcaacgagaagcacgacgaggaguucugcgacaugcugcggcuguucgacuucaacaagcaggccauccagcgccugaagaccgaggcgcagaugagcauccagcugaucaacaaggccgugaacgcccucaucaacgaccagcugaucaugaagaaccaccuccgggacaucauggggauccccuacugcaacuacuccaaguacugguaccucaacaacaccaucaccggcaagagcucccugcccaagugcuggcuggugagcaacggcuccuaccucaacgagacgcacuucagcgacgacaucgagcaggaggccgacaacaugaucaccgagaugcugcagaaggaguacauggagcgccaggggaagacgccccugggccucgucgaccuguucguguucuccaccagcuucuaccugaucuccaucuuccugcaccucgugaagaucccgacccaccggcacaucgucgggaagcccugccccaagccccaccgccugaaccacaugggcgugugcagcugcgggcuguacaagcagccgggcgugcccguccgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4873 - RNA, 1693 nt, Artificial Sequence
  mRNA product Design1 comprising derived and/or modified sequence from Lassa virus__AIT17228__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcugcucacguuccugcugcucugcggccgcuccugcaccaccagccuguacaagggggucuacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccggggacgcggccaaccacugcggcacggucgccaacggggugcuccagaccuucaugcggauggccuggggcggcagcuacaucgcgcuggacuccgggcgcggcgggugggacugcaucaugaccagcuaccaguaccugaucauccagaacaccacgugggaggaccacugccaguucucccggcccagccccaucggcuaccucggccugcugucccagcgcacccgggacaucuacaucagccgccggcuccuggggaccuucaccuggacgcugagcgacuccgagggcaaggacacccccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaaggcggaggcccagaugagcauccagcucaucaacaaggccgucaacgcccugaucaacgaccagcugaucaugaagaaccaccuccgggacaucaugggcauccccuacugcaacuacuccaaguacugguaccugaaccacacgaccaccggcaagaccagccugcccaagugcuggcucguguccaacgggagcuaccugaacgagacgcacuucuccgacgacaucgagcagcaggccgacaacaugaucaccgagaugcugcagaaggaguacauggagcgccagggcaagaccccgcucgggcugguggaccuguucgucuucagcaccuccuucuaccugaucagcaucuuccuccaccuggugaagaucccgacgcaccggcacaucgugggcaaguccugccccaagccccaccgccugaaccacauggggaucugcagcugcggccucuacaagcagcccggcgucccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4874 - RNA, 1693 nt, Artificial Sequence
  mRNA product Design1 comprising derived and/or modified sequence from Lassa virus__AIT17232__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgaggggaagaucuccguccaguacaaccugagccacuccuacgccggcgacgcggccaaccacugcgggacgguggccaacggcgugcugcagaccuucaugcgcauggccuggggcgggagcuacaucgcgcucgacuccggccgggggaagugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccaucgagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaaguccugccccaagccccaccggcugaaccacauggggaucugcagcugcggccuguacaagcagcccggggugccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4875 - RNA, 1693 nt, Artificial Sequence
  mRNA product Design1 comprising derived and/or modified sequence from Lassa virus__AIT17236__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggccggaucuccguccaguacaaccugagccacuccuacgccggggaggcggccaaccacugcggcacgguggccaacggggugcugcagaccuucaugcgcauggccuggggcggcagcuacaucgcgcucgacuccgggcggggcaagugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacucccgguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaaguccugccccaagccccaccgccugaaccacaugggcaucugcagcugcgggcuguacaagcagcccggcgugccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4876 - RNA, 1693 nt, Artificial Sequence
  mRNA product Design1 comprising derived and/or modified sequence from Lassa virus__AIT17240__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaagggguucuacgagcugcagacccucgagcugaacauggagacgcugaacaugaccaugccgcucuccugcaccaagaacaacagccaccacuacauccgggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccggggacgcggccaaccacugcggcacggucgccaacggggugcuccagaccuucaugcgcauggccuggggcggcagcuacaucgcgcuggacuccgggcggggccgcugggacugcaucaugaccagcuaccaguaccugaucauccagaacaccacgugggaggaccacugccaguucucccggcccagccccaucggguaccucggccugcugucccagaagacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccauccagcggcugaaggcggaggcccagaugagcauccagcucaucaacaaggccgucaacgcccugaucaacgaccagcugaucaugaagaaccaccuccgcgacaucauggggauccccuacugcaacuacuccaaguacugguaccugaaccacacgaccaccggcaagaccagccugcccaagugcuggcucguguccaacggcagcuaccugaacgagacgcacuucuccgacgacaucgagcagcaggccgacaacaugaucaccgagaugcugcagaaggaguacauggagcggcaggggaagacgccccucggccugguggaccuguucgucuucagcaccuccuucuaccugaucagcaucuuccuccaccuggugaagaucccgacccaccgccacaucguggggaaguccugccccaagccccaccggcugaaccacaugggcaucugcagcugcgggcucuacaagcagcccggcgucccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4877 - RNA, 1693 nt, Artificial Sequence
  mRNA product Design1 comprising derived and/or modified sequence from Lassa virus__AIT17244__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucaccuuccugcugcucugcggccgcuccugcaccaccaaccuguacaaggggguguacgagcugcagacccucgagcugaacauggagacgcugaacaugaccaugccgcucagcugcaccaagaacuccagccaccacuacauccgggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgugggggacgccgcggaccacugcggcacgguggccaacgggguccuccagaccuucaugcgcauggccuggggcggcagcuacaucgcccuggacuccgggcggggcaagugggacugcaucaucaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggcggagcugaagugcuucggcaacaccgccguggccaagugcaacgagaagcacgacgaggaguucugcgacaugcuccgccuguucgacuucaacaagcaggccauccagcggcugaaggccgaggcgcagaugagcauccagcucaucaacaaggccgugaacgcccugaucaacgaccagcugaucaugaagaaccaccuccgcgacaucauggggauccccuacugcaacuacuccaaguacugguaccugaaccacacgaucaccggcaagaccagccugccccggugcuggcucgucuccaacggcagcuaccugaacgagacccgcuucuccgacgacaucgagcagcaggccgacaacaugaucacggagaugcugcagaaggaguacauggagcggcaggggaagacgccccucggccugguggaccuguucguguucagcaccuccuucuaccugaucagcaucuuccuccaccuggucaagaucccgacccaccgccacaucguggggaagcccugccccaagccccaccggcugaaccacaugggcaucugcuccugcgggcucuacaagcagccgggcgugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4878 - RNA, 1693 nt, Artificial Sequence
  mRNA product Design1 comprising derived and/or modified sequence from Lassa virus__AIT17246__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucaucacguuccugcugcucugcggccgcuccugcaccaccaaccuguacaagggggucuacgagcugcagacccucgagcugaacauggagacgcugaacaugaccaugccgcucagcugcaccaagaacuccagccaccacuacaucauggugggcaacgagaccggccuggagcugacgcucaccaacaccuccaucaucaaccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccgugcaguacaaccugagccacuccuacgccgucgacgccgcgaaccacugcgggaccguggccaacggcauccuccagaccuucaugcggauggccuggggcgggagcuacaucgcccuggacuccggccgcgggaacugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagaugagcauccagcucaucaacaaggccgucaacgcccugaucaacgaccagcugaucaugaagaaccaccuccgggacaucaugggcauccccuacugcaacuacuccaaguacugguaccugaaccacaccaccaccgggaagacgagccugcccaagugcuggcucguguccaacggcagcuaccugaacgagacccacuucuccgacgacaucgagcagcaggccgacaacaugaucaccgagaugcugcagaaggaguacauggagcgccagggcaagaccccgcucgggcugguggaccuguucgucuucagcacguccuucuaccugaucagcaucuuccuccaccuggugaagaucccgacccaccggcacaucgugggcaagcccugccccaagccccaccgccugaaccacauggggaucugcuccugcggccucuacaagcagccggggguccccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4879 - RNA, 1693 nt, Artificial Sequence
  mRNA product Design1 comprising derived and/or modified sequence from Lassa virus__AIT17250__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacacccucaugagcaucaucuccacguuccaccugagcauccccaacuucaaccaguacgaggccauguccugcgacuucaacgggggcaagaucagcguccaguacaaccugucccacagcuacgccguggacgccgcgaaccacugcgggaccguggccaacggcguccuccagaccuucaugcggauggccuggggcggguccuacaucgcccuggacagcggccgcgggaacugggacugcaucaugaccuccuaccaguaccugaucauccagaacacgaccugggaggaccacugccaguucagccggcccucccccaucggcuaccucgggcugcugagccagcgcacccgggacaucuacaucucccgccggcuccugggcaccuucacguggacccugagcgacagcgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagauguccauccagcucaucaacaaggccgugaacgcccugaucaacgaccagcugaucaugaagaaccaccuccgggacaucaugggcauccccuacugcaacuacagcaaguacugguaccugaaccacaccaccaccgggaagacgucccugcccaagugcuggcucgucagcaacggcuccuaccugaacgagacccacuucagcgacgacaucgagcagcaggccgacaacaugaucaccgagaugcugcagaaggaguacauggagcgccagggcaagaccccgcucgggcugguggaccuguucguguucuccacgagcuucuaccugaucuccaucuuccuccaccuggucaagaucccgacccaccggcacaucgugggcaagcccugccccaagccccaccgccugaaccacauggggaucugcagcugcggccucuacaagcagccgggggugcccguccgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4880 - RNA, 1693 nt, Artificial Sequence
  mRNA product Design1 comprising derived and/or modified sequence from Lassa virus__AIT17254__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggcaucguggggcuggucacguuccugcuccugugcggccgcuccugcaccaccagccuguacaaggggguguacgagcuccagacccuggagcugaacauggagacgcucaacaugaccaugccgcuguccugcaccaagaacaacagccaccacuacaucauggugggcaacgagaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccggggacgcggccaaccacugcggcacgguggccaacggggugcugcagaccuucaugcggauggccuggggcggcagcuacaucgcgcuggacuccgggcgcgaccggugggacugcaucaugaccagcuaccaguaccucaucauccagaacaccacgugggaggaccacugccaguucucccgccccagccccaucggcuaccuggggcugcucucccagcggacccgcgacaucuacaucagccggcgccugcugggcaccuucaccuggacgcucagcgacuccgagggcaagaacacccccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggccauccagcggcucaaggcggaggcccagaugagcaucucccugaucaacaaggccgugaacgcccugaucaacgaccagcucaucaugaagaaccaccuccgcgacaucaugggcauccccuacugcaacuacagcaaguacugguaccugaaccacacgaccaccgggaagaccucccugccccggugcuggcuggugagcaacggcuccuaccugaacgagacgcacuucagcgacgacaucgagcagcaggccgacaacaugaucaccgagaugcuccagaaggaguacauggaccgccagggcaagaccccgcuggggcuggucgaccucuucguguucuccaccagcuucuaccugaucuccaucuuccugcaccuggugaagaucccgacgcaccggcacaucgucggcaagaccugccccaagccccaccgccucaaccacauggggaucugcagcugcggccuguacaagcagcccggggugccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4881 - RNA, 1693 nt, Artificial Sequence
  mRNA product Design1 comprising derived and/or modified sequence from Lassa virus__AIT17258__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucgucagcaccuuccaccucuccauccccaacuucaaccaguacgaggccaugagcugcgacuucaacgggggcaagaucuccgugcaguacaaccugagccacuccuacgccguggacgcggccaaccacugcgggacggucgccaacggcgugcugcagaccuucaugcggauggccuggggcgggagcuacaucgcgcucgacuccggccgcgggggcugggacugcaucaugaccagcuaccaguaccugaucauccagaacgugaccugggaggaccacugccaguucucccggcccagccccaucggguaccugggccuccugucccagcgcacgcgggacgucuacaucagccgccggcugcucggcaccuucaccuggacccugagcgacuccgaggggaacgacacgccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacaccacgaccggcaagaccagccugcccaagugcuggcuggucuccaacggcagcuaccucaacgagacccacuucuccgacgacaucgagcagcaggccgacaacaugaucacggagaugcugcagaaggaguacauggagcgccaggggaagacgccccugggccucguggaccuguucguguucagcaccuccuucuaccugaucagcaucuuccugcaccucgucaagaucccgacccaccggcacaucguggggaagcccugccccaagccccaccgccugaaccacaugggcaucugcuccugcgggcuguacaagcagccgggcgugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4882 - RNA, 1693 nt, Artificial Sequence
  mRNA product Design1 comprising derived and/or modified sequence from Lassa virus__AIT17262__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccacgcacugcggcaccguggccaacggggugcuccagaccuucaugcggauggccuggggcggcagcuacaucgcgcuggacuccgggcgcggcaagugggacugcaucaugaccagcuaccaguaccugaucauccagaacacgaccugggaggaccacugccaguucucccggcccagccccaucggguaccucggccugcugucccagcgcacccgggacaucuacaucagccgccggcuccugggcaccuucacguggacccugagcgacuccgaggggaaggacaccccgggcggguacugccucacccgcuggaugcugaucgaggccgagcugaagugcuucggcaacacggccgucgccaagugcaacgagaagcacgacgaggaguucugcgacaugcuccggcuguucgacuucaacaagcaggccauccagcgccugaagaccgaggcgcagaugagcauccagcucaucaacaaggccgugaacgcccugaucaacgaccagcugaucaugaagaaccaccuccgggacaucauggggauccccuacugcaacuacuccaaguacugguaccugaaccacaccaccacgggcaagaccagccugccccgcugcuggcucguguccaacggcagcuaccugaacgagacccacuucuccgacgacaucgagcagcaggccgacaacaugaucaccgagaugcugcagaaggaguacauggagcggcaggggaagacgccccucggccuggucgaccuguucguguucagcaccuccuucuaccugaucagcaucuuccuccaccuggugaagaucccgacccaccgccacaucgucgggaagcccugccccaagccccaccggcugaaccacaugggcaucugcuccugcgggcucuacaagcagccgggcgugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4883 - RNA, 1693 nt, Artificial Sequence
  mRNA product Design1 comprising derived and/or modified sequence from Lassa virus__AIT17266__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccucccugaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccaaccacugcgggacgguggccaacggcguccugcagaccuucaugcggauggccuggggcgggagcuacaucgcgcuggacuccggccgcgggggcugggacugcaucaugaccagcuaccaguaccucaucauccagaacaccacgugggaggaccacugccaguucucccggcccagccccaucggguaccugggccugcucucccagcgcacccgggacaucuacaucagccgccggcugcugggcaccuucaccuggacgcucagcgacuccgaggggaaggacaccccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggccauccagcgccucaaggcggaggcccagaugagcauccagcugaucaacaaggccgugaacgcccugaucaacgaccagcucaucaugaagaaccaccuccgggacaucauggggauccccuacugcaacuacuccaaguacugguaccugaaccacacgaccaccggccgcaccagccugccccggugcuggcuggucuccaacggcagcuaccugaacgagacgcacuucuccgacgacaucgagcagcaggccgacaacaugaucaccgagaugcuccagaaggaguacauggagcgccaggggaagacgccccugggccugguggaccuguucguguucagcaccuccuucuaccucaucagcaucuuccugcaccuggucaagaucccgacccaccggcacaucguggggaaguccugccccaagccccaccgccucaaccacaugggcaucugcagcugcgggcuguacaagcagcccggcgugccggucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4884 - RNA, 1693 nt, Artificial Sequence
  mRNA product Design1 comprising derived and/or modified sequence from Lassa virus__AIT17270__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugaccuuccuccugcugugcggccgcuccugcagcaccuccguguacaagggggucuacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacagcuacgccgucgacgcggccaaccacugcgggaccguggccaacggcgugcugcagacguucaugcggauggccuggggcggguccuacaucgcgcuggacagcggccacgggggcugggacugcaucaugaccaacuaccaguaccucaucauccagaacaccaccugggaggaccacugccaguucucccgccccagccccaucggguaccugggccugcucucccagcggacgcgcgacaucuacaucagccggcgccugcugggcaccuucaccuggacccucagcgacuccgaggggaaggacacgccgggcggguacugccugacccgguggaugcugaucgaggccgagcucaagugcuucggcaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacaccacgaccggccggaccagccugcccaagugcuggcugguguccaacggcagcuaccugaacgagacccacuucuccgacgacaucgagcagcaggccgacaacaugaucacggagaugcuccagcgcgaguacauggagcggcaggggaagacgccccugggccuggucgaccucuucguguucagcaccuccuucuaccugaucagcaucuuccugcaccuggugaagaucccgacccaccgccacaucgucgggaaguccugccccaagccccaccggcucaaccacaugggcaucugcagcugcgggcuguacaagcagcccggcgugccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4885 - RNA, 1693 nt, Artificial Sequence
  mRNA product Design1 comprising derived and/or modified sequence from Lassa virus__AIT17274__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugacggggcuggucgccuuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucgagcaccgcuucugcaaccucuccgacgcccacaagaagaaccuguacgaccacgcccugaugagcaucaucuccaccuuccaccucagcauccccaacuucaaccaguacgaggcgauguccugcgacuucaacgggggcaagaucagcguccaguacaaccugucccacagcuacgccguggacgccgccaaccacugcgggacgguggcgaacggcguccugcagaccuucaugcggauggccuggggcggguccuacaucgcccucgacagcggccgcaacgggugggacugcaucaugaccuccuaccaguaccugaucauccagaacaccacgugggaggaccacugccaguucagccggcccucccccaucggcuaccuggggcuccugagccagcgcacccgggacaucuacaucucccgccggcugcucggcaccuucaccuggacgcugagcgacagcgagggcaaggacacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgccugaaggccgaggcccagauguccauccagcugaucaacaaggccgugaacgcgcucaucaacgaccagcugaucaugaagaaccaccuccgggacaucaugggcauccccuacugcaacuacagcaaguacugguaccucaacaacacggccaccgggaagaccucccugccccgcugcuggcuggucagcaacggcuccuaccucaacgagacccacuucagcgacgacaucgagcagcaggccgacaacaugaucacggagaugcugcagaaggaguacauggagcggcagggcaagaccccgcuggggcucguggaccuguucguguucuccaccagcuucuaccugaucuccaucuuccugcaccucgucaagaucccgacccaccgccacaucgugggcaagcccugccccaagccccaccggcugaaccacauggggaucugcagcugcggccuguacaagcagccgggggcccccgugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4886 - RNA, 1693 nt, Artificial Sequence
  mRNA product Design1 comprising derived and/or modified sequence from Lassa virus__AIT17276__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggcaagugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcgggcuguacaagcagcccggcgugccggugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4887 - RNA, 1690 nt, Artificial Sequence
  mRNA product Design1 comprising derived and/or modified sequence from Lassa virus__AIT17280__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucgaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcgcauggccuggggcggcagcuacaucgcgcucgacuccgggcacgagugggacugcaucaugaccagcuaccaguaccugaucauccagaacaccacgugggacaaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaagguggaggcgcagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcuggucuccaacggcagcuaccucaacgagacgcacuucuccgacgacaucgagcagcaggccgacaacaugaucaccgagaugcugcagaaggaguacauggagcgccagggcaagaccccgcuggggcucguggaccuguucguguucagcaccuccuucuaccugaucagcaucuuccugcaccucgucaagaucccgacgcaccggcacaucgugggcaaguccugccccaagccccaccgccugaaccacauggggaucugcagcugcggcuucuacaagcagcccggggugccggucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4888 - RNA, 1693 nt, Artificial Sequence
  mRNA product Design1 comprising derived and/or modified sequence from Lassa virus__AIT17288__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccguggacgcggccaaccacugcgggacgguggccaacggcguccugcagaccuucaugcggauggccuggggcgggggcuacaucgcgcucgacagcgggcgcggcaacugggacugcaucaugaccuccuaccaguaccugaucauccagaacaccacgugggaggaccacugccaguucagccggcccucccccaucggguaccugggccuccugagccagcgcacccgggacaucuacaucucccgccggcugcucggcaccuucaccuggacgcugagcgacagcgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagauguccauccagcugaucaacaaggccgugaacgcccucaucaacgaccagcugaucaugaagaaccaccuccgggacaucauggggauccccuacugcaacuacagcaaguacugguaccucaaccacacggucaccggcaagaccucccugcccaagugcuggcuggugagcaacggcuccuaccucaacgagacccacuucagcgacgacaucgagcagcaggccgacaacaugaucacggagaugcugcagaaggaguacauggagcgccaggggaagacgccccugggccucguggaccuguucgucuucuccaccagcuucuaccugaucuccaucuuccugcaccucgugaagaucccgacccaccggcacaucgugggcaagagcugccccaagccccaccgccugaaccacauggggaucugcuccugcgggcuguacaagcagcccggcgucccggugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4889 - RNA, 1693 nt, Artificial Sequence
  mRNA product Design1 comprising derived and/or modified sequence from Lassa virus__AIT17292__GPC (opt1)
gggagaaagcuuaccaugggccagaucgugaccuucuuccaggaggucccccacgugaucgaggaggugaugaacaucguccugaucgcccucagcaucauggccgugcugaaggggcuguacaacaucgcgaccugcggccucguggggcuggucacguuccugcuccugugcggccgcuccugcaccaccacccuguacaaggggguguacgagcuccagacgcuggagcugaacauggagacccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcguccaguacaaccucucccacagcuacgccggggacgcggccaaccacugcggcaccguggccaacggggugcugcagaccuucaugcggauggccuggggcggcuccuacaucgcgcuggacagcgggcacggcgggugggacugcaucaugaccuccuaccaguaccucaucauccagaacacgaccugggaggaccacugccaguucacccgccccagccccaucggcuaccugggccugcucucccagcggacccgcgacaucuacaucagccggcgccugcuggggacguucaccuggacccucuccgacagcgagggcaacgacacccccgggggcuacugccugacgcgguggaugcugaucgaggccgagcucaagugcuucgggaacaccgccgucgccaagugcaacgagaagcacgacgaggaguucugcgacaugcugcgccuguucgacuucaacaagcaggccauccagcggcuccgcgcggaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccaccacgggccgcaccagccugccccggugcuggcugguguccaacgggagcuaccugaacgagacccacuucuccgacgacaucgagcagcaggccgacaacaugaucaccgagaugcuccagaaggaguacauggagcgccagggcaagacgccccuggggcuggucgaccucuucguguucagcaccuccuucuaccugaucagcaucuuccugcaccugaucaagaucccgacccaccggcacaucgugggcaagcccugccccaagccccaccgccucaaccacaugggggucugcuccugcggccuguacaagcagccgggcgugcccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4890 - RNA, 1693 nt, Artificial Sequence
  mRNA product Design1 comprising derived and/or modified sequence from Lassa virus__AIT17294__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggcgggugggacugcaucaugaccagcuaccaguaccugaucauccagaacaccacgugggaggaccacugccaguucucccggcccagccccgucggcuaccucggccugcugucccagcgcacccgggacaucuacaucagccgccggcuccuggggaccuucaccuggacgcugagcgacuccgagggcaaggacacccccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaagacggaggcgcagaugagcauccagcucaucaacaaggccgugaacgcccugaucaacgaccagcugaucaugaagaaccaccuccgggacaucaugggcauccccuacugcaacuacuccaaguacugguaccugaaccacaccaccaccggcaagacgagccugccccgcugcuggcucgucuccaacgggagcuaccugaacgagacccacuucuccgacgacaucgagcagcaggccgacaacaugaucaccgagaugcugcagaaggaguacauggagcggcagggcaagaccccgcucgggcugguggaccuguucguguucagcacguccuucuaccugaucagcaucuuccuccaccuggucaagaucccgacccaccgccacaucgugggcaagcccugccccaagccccaccggcugaaccacauggggaucugcuccugcggccucuacaagcagccgggcgugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4891 - RNA, 1693 nt, Artificial Sequence
  mRNA product Design1 comprising derived and/or modified sequence from Lassa virus__AIT17298__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugcuggggcucgugugcuuccugcugcucugcggccgcuccugcaccaccagccuguacaagggggucuacgagcugcagacccucgagcugaacauggagacccugaacaugacgaugccgcucuccugcaccaagaacaacagccaccacuacaucauggugggcaacgagaccggccuggagcugacccucacgaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccgucgacgcggccagccacugcgggaccaucgccaacggcgugcuccagacguucaugcggauggccuggggcggguccuacaucgcgcuggacagcggccacgggggcugggacugcaucaugaccuccuaccaguaccugaucauccagaacaccaccugggaggaccacugccaguucagccgccccucccccaucggguaccucggccugcugagccagcggacgcgcgacaucuacaucagccggcgccuccugggcaccuucaccuggacccuguccgacagcgaggggaaggacacgccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccauccagcggcugaaggcggaggcccagauguccauccagcucaucaacaaggccgucaacgcccugaucaacgaccagcugaucaugaagaaccaccuccgcgacaucauggggauccccuacugcaacuacagcaaguacugguaccugaaccacaccacgaccggcaagaccucccugcccaagugcuggcucgugagcaacggcuccuaccugaacgagacccacuucagcgacgacaucgagcagcaggccgacaacaugaucacggagaugcugcagaaggaguacauggagcggcaggggaagacgccccucggccugguggaccuguucgucuucuccaccagcuucuaccugaucuccaucuuccuccaccuggugaagaucccgacccaccgccacguggucgggaagcccugccccaagccccaccggcugaaccacaugggcaucugcagcugcgggcucuacggccagccgggcgugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4892 - RNA, 1693 nt, Artificial Sequence
  mRNA product Design1 comprising derived and/or modified sequence from Lassa virus__AIT17302__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucucccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccguccaguacaaccugagccacuccuacgccguggacgccgcgaaccacugcgggaccguggccaacggcguccuccagaccuucaugcggauggccuggggcgggagcuacaucgcccuggacuccggccgcgggaacugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagaugagcauccagcucaucaacaaggccgugaacgcccugaucaacgaccagcugaucaugaagaaccaccuccgggacaucaugggcauccccuacugcaacuacuccaaguacugguaccugaaccacaccaccaccgggaagacgagccugcccaagugcuggcucgucuccaacggcagcuaccugaacgagacccacuucuccgacgacaucgagcagcaggccgacaacaugaucaccgagaugcugcagaaggaguacauggagcgccagggcaagaccccgcucgggcugguggaccuguucguguucagcacguccuucuaccugaucagcaucuuccuccaccuggucaagaucccgacccaccggcacaucgugggcaagcccugccccaagccccaccgccugaaccacauggggaucugcuccugcggccucuacaagcagccgggggugcccguccgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4893 - RNA, 1693 nt, Artificial Sequence
  mRNA product Design1 comprising derived and/or modified sequence from Lassa virus__AIT17310__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccacgcacugcggcaccguggccaacggggugcuccagaccuucaugcggauggccuggggcggcagcuacaucgcgcuggacuccgggcgcggcaagugggacugcaucaugaccagcuaccaguaccugaucauccagaacacgaccugggaggaccacugccaguucucccggcccagccccaucggguaccucggccugcugucccagcgcacccgggacaucuacaucagccgccggcuccugggcaccuucacguggacccugagcgacuccgaggggaaggacaccccgggcggguacugccucacccgcuggaugcugaucgaggccgagcugaagugcuucggcaacacggccgucgccaagugcaacgagaagcacgacgaggaguucugcgacaugcuccggcuguucgacuucaacaagcaggccauccagcgccugaagaccgaggcgcagaugagcauccagcucaucaacaaggccgugaacgcccugaucaacgaccagcugaucaugaagaaccaccuccgggacaucauggggauccccuacugcaacuacuccaaguacugguaccugaaccacaccaccacgggcaagaccagccugccccgcugcuggcucguguccaacggcagcuaccugaacgagacccacuucuccgacgacaucgagcagcaggccgacaacaugaucaccgagaugcugcagaaggaguacauggagcggcaggggaagacgccccucggccuggucgaccuguucguguucagcaccuccuucuaccugaucagcaucuuccuccaccuggugaagaucccgacccaccgccacaucgucgggaagcccugccccaagccccaccggcugaacuacaugggcaucugcuccugcgggcucuacaagcagccgggcgugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4894 - RNA, 1693 nt, Artificial Sequence
  mRNA product Design1 comprising derived and/or modified sequence from Lassa virus__AIT17314__GPC (opt1)
gggagaaagcuuaccaugggccagaucgugaccuucuuccaggaggucccccacgugaucgaggaggugaugaacaucguccugaucacccucagcauccuggccgugcugaaggggcucuacaacguggccacgugcggccuggucgggcuggugaccuuccuccugcugugcggccgcuccugcaccaccagccucuacaaggggguguacgagcugcagacgcuggagcucaacauggagacccugaacaugaccaugccgcuguccugcaccaagaacaacagccaccacuacaucauggucggcaacgagacgggccucgagcugacccugaccaacaccuccaucaucaaccacaaguucugcaaccucagcgacgcgcacaagaaggaccuguacgaccacgcccugauguccaucaucagcacguuccaccucuccauccccaacuucaaccaguacgaggccaugagcugcgacuucaacgggggcaagaucuccgugcaguacaaccugagccacuccuacgccguggacgccgcgaaccacugcgggaccgucgccaacggcgugcugcagaccuucaugcggauggccuggggcgggagcuacaucgcccucgacuccggccgcgggggcugggacugcaucaugaccagcuaccaguaccugaucauccagaacacgaccugggaggaccacugccaguucucccggcccagccccaucggguaccugggccuccugucccagcgcacccgggacaucuacaucagccgccggcugcucggcaccuucacguggacccugagcgacuccgaggggaacgacaccccgggcggguacugccugacccgcuggaugcucaucgaggcggagcugaagugcuucggcaacacggccguggccaagugcaacgagaagcacgacgaggaguucugcgacaugcugcggcuguucgacuucaacaagcaggccauccagcgccugaaggccgaggcgcagaugagcauccagcugaucaacaaggccgucaacgcccucaucaacgaccagcugaucaugaagaaccaccuccgggacaucauggggauccccuacugcaacuacuccaaguacugguaccucaaccacaccaccaccggcaagacgagccugcccaagugcuggcugguguccaacggcagcuaccucaacgagacccacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaagcccugccccaagccccaccgccugaaccacaugggcaucugcuccugcgggcuguacaagcagccgggcguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4895 - RNA, 1693 nt, Artificial Sequence
  mRNA product Design1 comprising derived and/or modified sequence from Lassa virus__AIT17318__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgggggcaagaucagcguccaguacaaccugucccacagcuacgccguggacgcggccaaccacugcgggacgguggccaacggcguccuccagaccuucaugcggauggccuggggcggguccuacaucgcgcuggacagcggccgcgggaacugggacugcaucaugaccuccuaccaguaccugaucauccagaacaucaccugggaggaccacugccaguucagccggcccucccccaucggcuaccucgggcugcugagccagcgcacgcgggacaucuacaucucccgccggcuccugggcaccuucaccuggacccugagcgacagcgagggcaacgacacgcccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaaggcggaggcccagauguccauccagcucaucaacaaggccgugaacgcccugaucaacgaccagcugaucaugaagaaccaccuccgggacaucaugggcauccccuacugcaacuacagcaaguacugguaccugaaccacaccacgaccgggaagaccucccugcccaagugcuggcucgucagcaacggcuccuaccugaacgagacccacuucagcgacgacaucgagcagcaggccgacaacaugaucacggagaugcugcagaaggaguacauggagcgccagggcaagaccccgcucgggcugguggaccuguucguguucuccaccagcuucuaccugaucuccaucuuccuccaccuggucaagaucccgacccaccggcacaucgugggcaagcccugccccaagccccaccgccugaaccacauggggaucugcagcugcggccucuacaagcagccgggggugcccguccgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4896 - RNA, 1693 nt, Artificial Sequence
  mRNA product Design1 comprising derived and/or modified sequence from Lassa virus__AIT17322__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaagggggccuacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacacccucaugagcaucaucuccacguuccaccugagcauccccaacuucaaccaguacgaggccauguccugcgacuucaacgggggcaagaucagcgugcaguacaaccugucccacagcuacgccgucgacgcggccaaccacugcgggaccguggccaacggcgugcuccagaccuucaugcggauggccuggggcggguccuacaucgcgcuggacagcggccgcgggaacugggacugcaucaugaccuccuaccaguaccugaucauccagaacacgaccugggaggaccacugccaguucagccggcccucccccaucggcuaccucgggcugcugagccagcgcacccgggacaucuacaucucccgccggcuccugggcaccuucacguggacccugagcgacagcgagggcaacgacacccccgggggcuacugccucacccgcuggaugcugaucgaggccgagcugaagugcuucgggaacacggccgucgccaagugcaacgagaagcacgacgaggaguucugcgacaugcuccggcuguucgacuucaacaagcaggccauccagcgccugaaggcggaggcccagauguccauccagcucaucaacaaggccgugaacgcccugaucaacgaccagcugaucaugaagaaccaccuccgggacaucaugggcauccccuacugcaacuacagcaaguacugguaccugaaccacaccaccaccgggaagacgucccugcccaagugcuggcucgugagcaacggcuccuaccugaacgagacccacuucagcgacgacaucgagcagcaggccgacaacaugaucaccgagaugcugcagaaggaguacauggagcgccagggcaagaccccgcucgggcuggucgaccuguucguguucuccacgagcuucuaccugaucuccaucuuccuccaccuggugaagaucccgacccaccggcacaucgucggcaagcccugccccaagccccaccgccugaaccacauggggaucugcagcugcggccucuacaagcagccgggggugcccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4897 - RNA, 1693 nt, Artificial Sequence
  mRNA product Design1 comprising derived and/or modified sequence from Lassa virus__AIT17328__GPC (opt1)
gggagaaagcuuaccaugggccagaucgugaccuucuuccaggaggucccccacgugaucgaggaggugaugaacaucguccugaucacccucagcauccuggccgugcugaaggggcucuacaacaucgccacgugcggccugguggggcuggucaccuuccuccugcugugcggcaaguccugcaccaccagccucuacaaggggguguacgagcugcagacgcuggagcucaacauggagacccugaacaugaccaugccgcuguccugcaccaagaacaacagccaccacuacauccgcgugggcaacgagacgggccucgagcugacccugaccaacaccuccaucaucaaccacaaguucugcaaccucagcgacgcgcacaagaagaaccuguacgaccacgcccugauguccaucaucagcacguuccaccucuccauccccaacuucaaccaguacgaggccaugagcugcgacuucaacgggggcaagaucuccguccaguacaaccugagccacuccuacgccguggacgccgcgaaccacugcgggaccguggccaacggcguccugcagaccuucaugcggauggccuggggcgggagcuacaucgcccucgacuccggccacgggaacugggacugcaucaugaccagcuaccaguaccugaucauccagaacacgaccugggaggaccacugccaguucucccgccccagccccaucggcuaccuggggcuccugucccagcggacccgcgacaucuacaucagccggcgccugcucggcaccuucacguggacccugagcgacuccgagggcaacgacgcgcccgggggcuacugccugacccgguggaugcucaucgaggccgagcugaagugcuucgggaacaccgccguggccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcuggucuccaacggcagcuaccucaacgagacgcacuucuccgacgacaucgagcagcaggccgacaacaugaucaccgagaugcugcagaaggaguacauggagcggcagggcaagaccccgcuggggcucguggaccuguucguguucagcaccuccuucuaccugaucagcaucuuccugcaccucgucaagaucccgacgcaccgccacguggugggcaaguccugccccaagccccaccggcugaaccacauggggaucugcagcugcggccuguacaagcagcccggggucccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4898 - RNA, 1693 nt, Artificial Sequence
  mRNA product Design1 comprising derived and/or modified sequence from Lassa virus__AIT17332__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacauccgggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccguggacgcggccaaccacugcgggacgguggccaacggcguccuccagaccuucaugcgcauggccuggggcgggagcuacaucgcgcuggacuccggccacgggcggugggacugcaucaugaccagcuaccaguaccugaucauccagaacaccacgugggaggaccacugccucuucucccgccccagccccaucggcuaccuggggcugcucucccagcggacccgcgacaucuacaucagccggcgccugcugggcaccuucaccuggacgcucagcgacuccgagggccgggacacccccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggccauccagcgccucaaggcggaggcccagaugagcauccagcugaucaacaaggccgugaacgcccugaucaacgaccagcucaucaugaagaaccaccuccgggacaucaugggcauccccuacugcaacuacuccaaguacugguaccugaaccacacgaccaccgggcgcaccagccugccccggugcuggcuggucuccaacggcagcuaccugaacgagacgcacuucuccgacgacaucgagcagcaggccgacaacaugaucaccgagaugcuccagaaggaguacauggagcgccagggcaagaccccgcuggggcugguggaccuguucguguucagcaccuccuucuaccucaucagcaucuuccugcaccuggucaagaucccgacgcaccggcacaucgugggcaaguccugccccaagccccaccgccucaaccacauggggaucugcagcugcggccuguacaagcagcccggggugccggucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4899 - RNA, 1693 nt, Artificial Sequence
  mRNA product Design1 comprising derived and/or modified sequence from Lassa virus__AIT17340__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaucuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcggcgagugggacugcaucaugaccagcuaccaguaccugaucauccagaacaccaccugggaggaccacugccaguucucccggcccagccccaucggguaccugggccuccugucccagcgcacgcgggacaucuacaucagccgccggcugcucggcaccuucaccuggacccugagcgacuccgaggggaaggacacgccgggcggguacugccugacccgcuggaugcucaucgaggccgagcugaagugcuucggcaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacaccacgaccggcaagaccagccugcccaagugcuggcugguguccaacggcagcuaccucaacgagacccacuucuccgacgacaucgagcagcaggccgacaacaugaucacggagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugcccccgcccccaccggcugaaccacaugggcaucugcuccugcgggcuguacaagcagccgggcgugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4900 - RNA, 1693 nt, Artificial Sequence
  mRNA product Design1 comprising derived and/or modified sequence from Lassa virus__AIT17344__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacaaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccagccacugcggcacgguggccaacggggugcugcagaccuucaugcggauggccuggggcggcuccuacaucgcgcucgacagcggguacggcaagugggacugcaucaugaccuccuaccaguaccugaucauccagaacaccacgugggaggaccacugccaguucagccgccccucccccaucggguaccugggccuccugagccagcggacccgcgacaucuacaucagccggcgccugcucggcaccuucaccuggacgcuguccgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaagacggaggcgcagauguccauccagcugaucaacaaggccgugaacgcccucaucaacgaccagcugaucaugaagaaccaccuccgcgacaucauggggauccccuacugcaacuacagcaaguacugguaccugaaccacaccaccaccggcaagacgucccugcccaagugcuggcuggugagcaacggcuccuaccucaacgagacccacuucagcgacgacaucgagcagcaggccgacaacaugaucaccgagaugcugcagaaggaguacauggagcggcaggggaagacgccccugggccucgucgaccuguucguguucuccaccagcuucuaccugaucuccaucuuccugcaccucgugaagaucccgacccaccgccacaucgucggcaagagcugccccaagccccaccggcugaaccacauggggaucugcuccugcgggcuguacaagcagcccggcgugccggugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4901 - RNA, 1693 nt, Artificial Sequence
  mRNA product Design1 comprising derived and/or modified sequence from Lassa virus__AIT17348__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaacgacaccccgggcggguacugccugacccgguggaugcucaucgaggccgagcugaagugcuucggcaacaccgccguggccaagugcaacgagaagcacgacgaggaguucugcgacaugcugcgccucuucgacuucaacaagcaggccauccagcggcugaaggcggaggcccagaugagcauccagcugaucaacaaggccgucaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucguggaccuguucgucuucagcaccuccuucuaccugaucagcaucuuccugcaccucgugaagaucccgacccaccgccacaucguggggaagcccugccccaagccccaccggcugaaccacaugggcaucugcuccugcgggcuguacaagcagccgggcguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4902 - RNA, 1693 nt, Artificial Sequence
  mRNA product Design1 comprising derived and/or modified sequence from Lassa virus__AIT17350__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacaucauggugggcaacgagaccggccucgagcugacgcugaccaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgggggacgccgccaagcacugcggcacgguggccaacggggugcugcagaccuucaugcggauggcguggggcggcuccuacaucgcccucgacagcgggcgcaacggcugggacugcgucaugaccuccuaccaguaccugaucauccagaacaccacgugggaggaccacugccaguucagccggcccucccccaucggguaccugggccuccugagccagcgcacccgggacaucuacaucucccgccggcugcucggcaccuucaccuggacgcugagcgacagcgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggcgauccagcgccugaagacggaggcccagauguccauccagcugaucaacaaggccgugaacgcccucaucaacgaccagcugaucaugaagaaccaccuccgggacaucauggggauccccuacugcaacuacagcaaguacugguaccucaaccacaccgucaccggcaagaccucccugccccgcugcuggcuggugagcaacggcuccuaccucaacgagacgcacuucagcgacgacaucgagcagcaggccgacaacaugaucaccgagaugcugcagaaggaguacaucgagcggcaggggaagacgccccugggccucguggaccuguucgucuucuccaccagcuucuaccugaucuccaucuuccugcaccucgugaagaucccgacccaccgccacaucaucgggaagcccugccccaagccccaccggcugaaccacaugggcaucugcagcugcgggcuguacaagcagccgggcgugcccguccgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4903 - RNA, 1693 nt, Artificial Sequence
  mRNA product Design1 comprising derived and/or modified sequence from Lassa virus__AIT17354__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaucuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcacggcgggugggacugcaucaugaccagcuaccaguaccugaucauccagaacaccaccugggaggaccacugccaguucucccgccccagccccaucggcuaccugggccuccugucccagcggacgcgcgacaucuacaucagccggcgccugcucgggaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacaccacgaccggcaagaccagccugcccaagugcuggcugguguccaacgggagcuaccucaacgagacccacuucuccgacgacaucgagcagcaggccgacaacaugaucacggagaugcugcagaaggaguacauggagcggcagggcaagaccccgcuggggcucgucgaccuguucguguucagcaccuccuucuaccugaucagcaucuuccugcaccucgugaagaucccgacccaccgccacaucgucggcaagcccugcccccggccccaccgccugaaccacauggggaucugcuccugcggccuguacaagcagccgggcgugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4904 - RNA, 1693 nt, Artificial Sequence
  mRNA product Design1 comprising derived and/or modified sequence from Lassa virus__AIT17360__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucaaccaccgcuucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggcaagugggacugcaucaugaccagcuaccaguaccugaucauccagaacaccacgugggacgaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccggcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccugaaccacacgaccaccggcaagaccagccugccccgcugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcggguucuacaagcagcccggcgugccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4905 - RNA, 1693 nt, Artificial Sequence
  mRNA product Design1 comprising derived and/or modified sequence from Lassa virus__AIT17364__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacaucgagcggcagggcaagaccccgcuggggcucgucgaccuguucguguucagcaccuccuucuaccugaucagcaucuuccugcaccucgugaagaucccgacgcaccgccacaucgucggcaagcccugccccaagccccaccggcugaaccacauggggaucugcuccugcggccuguacaagcagccgggggugagcgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4906 - RNA, 1693 nt, Artificial Sequence
  mRNA product Design1 comprising derived and/or modified sequence from Lassa virus__AIT17368__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguucgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacagcaagugggacugcaucaugaccuccuaccaguaccugaucauccagaacaccacgugggacgaccacugccaguucagccgccccucccccaucggcuaccuggggcuccugagccagcggacccgcgacaucuacaucagccggcgccugcucggcaccuucaccuggacgcuguccgacagcgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagauguccauccagcugaucaacaaggccgugaacgcccucaucaacgaccagcugaucaugaagaaccaccuccgcgacaucaugggcauccccuacugcaacuacagcaaguacugguaccugaaccacacgaccaccgggaagaccucccugcccaagugcuggcuggugagcaacggcuccuaccucaacgagacgcacuucagcgacgacaucgagcagcaggccgacaacaugaucaccgagaugcugcagaaggaguacauggagcggcagggcaagaccccgcuggggcucgucgaccuguucguguucuccaccagcuucuaccugaucuccaucuuccugcaccucgugaagaucccgacgcaccgccacaucgucggcaagagcugccccaagccccaccggcugaacuacauggggaucugcuccugcggcuucuacaagcagcccggggugccggugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4907 - RNA, 1693 nt, Artificial Sequence
  mRNA product Design1 comprising derived and/or modified sequence from Lassa virus__AIT17370__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaagcccugccccaagccccaccggcugaaccacauggggaucugcuccugcggccuguacaagcagccgggggugagcgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4908 - RNA, 1693 nt, Artificial Sequence
  mRNA product Design1 comprising derived and/or modified sequence from Lassa virus__AIT17378__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccguccaguacaaccugagccacuccuacgccguggacgccgcgaaccacugcgggaccguggccaacggcguccuccagaccuucaugcggauggccuggggcgggagcuacaucgcccuggacuccggccgcagcgggugggacugcaucaugaccuccuaccaguaccuggugauccagaacacgaccugggaggaccacugccaguucagccggcccucccccaucggcuaccucgggcugcugagccagcgcacccgggacaucuacaucagccgccggcuccugggcaccuucacguggacccuguccgacagcgagggcaagaacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagauguccauccagcucaucaacaaggccgucaacgcccugaucaacgaccagcugaucaugaagaaccaccuccgggacaucaugggcauccccuacugcaacuacagcaaguacugguaccugaaccacaccaccaccgggcgcacgucccugccccggugcuggcucgugagcaacggcuccuaccugaacgagacccacuucagcgacgacaucgagcagcaggccgacaacaugaucaccgagaugcugcagaaggaguacauggagcgccagggcaagaccccgcucgggcugguggaccuguucgucuucuccacgagcuucuaccugaucuccaucuuccuccaccuggugaagaucccgacccaccggcacaucgugggcaagagcugccccaagccccaccgccugaaccacauggggaucugcuccugcggcuucuacaagcagcccggggucccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4909 - RNA, 1693 nt, Artificial Sequence
  mRNA product Design1 comprising derived and/or modified sequence from Lassa virus__AIT17388__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaucaucagcguccaguacaaccugucccacagcuacgcgggggacgccgccaaccacugcggcacgguggccaacggggugcugcagaccuucaugcgcauggcguggggcggcuccuacaucgcccucgacagcgggcggaacggcugggacugcaucaugaccuccuaccaguaccugaucauccagaacaccacgugggacgaccacugccaguucagccgccccucccccaucggguaccugggccuccugagccagcggacccgcgacaucuacaucucccggcgccugcucggcaccuucaccuggacgcugagcgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggcgauccagcggcugaagacggaggcccagaugaacauccagcugaucaacaaggccgugaacgcccucaucaacgaccagcugaucaugaagaaccaccuccgcgacaucauggggauccccuacugcaacuacuccaaguacugguaccugaacaacaccgccaccggcaagaccagccugccccggugcuggcugguguccaacggcagcuaccucaacgagacgcacuucuccgacgacaucgagcagcaggcggacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugccccaagccccaccgccugaaccacaucggcaucugcuccugcgggcuguacaagcagccgggcgugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4910 - RNA, 1690 nt, Artificial Sequence
  mRNA product Design1 comprising derived and/or modified sequence from Lassa virus__AIT17404__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucaucaagaucccgacccaccgccacaucaccggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4911 - RNA, 1690 nt, Artificial Sequence
  mRNA product Design1 comprising derived and/or modified sequence from Lassa virus__AIT17408__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccgucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4912 - RNA, 1690 nt, Artificial Sequence
  mRNA product Design1 comprising derived and/or modified sequence from Lassa virus__AIT17412__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccuccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggcgaagugcaacgagaagcacgacgaggaguucugcgacaugcugcgccuguucgacuucaacaagcaggccauccggcgccucaagaccgaggcccagauguccauccagcugaucaacaaggccgugaacgcccugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggcggacaacaugaucaccgagcuccugcagaaggaguacaucgaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4913 - RNA, 1690 nt, Artificial Sequence
  mRNA product Design1 comprising derived and/or modified sequence from Lassa virus__AIT17416__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcgcauggccuggggcggguccuacaucgcccuggacagcggcaagggguccugggacugcaucaugacgagcuaccaguaccucaucauccagaacaccuccugggaggaccacugccaguucagccggcccagccccaucggcuaccuggggcugcucucccagcgcacccgggacaucuacaucagccgccggcugcugggcaccuucacguggacccucuccgacagcgagggcaacgagacccccgggggcuacugccugacccgcuggaugcugaucgaggccgagcucaagugcuucgggaacacggccguggcgaagugcaacgagaagcacgacgaggaguucugcgacaugcugcggcuguucgacuucaacaagcaggccauccgccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacaccgucaccgggaagacgucccugccccggugcuggcuggugagcaacggcuccuaccugaacgagacccacuucagcgacgacaucgagcagcaggcggacaacaugaucaccgagcuccugcagaaggaguacaucgaccgccagggcaagaccccgcuggggcucguggaccuguucgucuucuccacgagcuucuaccugaucuccaucuuccugcaccucgugaagaucccgacccaccggcacgugaucggcaagcccugccccaagccccaccgccugaaccacauggggaucugcagcugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4914 - RNA, 1690 nt, Artificial Sequence
  mRNA product Design1 comprising derived and/or modified sequence from Lassa virus__AIT17420__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucaucaagaucccgacccaccgccacaucacgggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4915 - RNA, 1690 nt, Artificial Sequence
  mRNA product Design1 comprising derived and/or modified sequence from Lassa virus__AIT17424__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacaaccacgcccugaugagcaucaucuccaccuuccaccugagcauccccaacuucaaccaguacgaggccauguccugcgacuucaacgggggcaagaucagcgugcaguacaaccucucccacgccuacgcgguggacgccgccaaccacugcgggaccaucgccaacggcguccugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagacgaacauccagcugaucaacaaggccgugaacgcccugaucaacgaccagcucaucaugaagaaccaccuccgggacaucaugggcauccccuacugcaacuacuccaaguacugguaccugaaccacaccgucaccgggaagaccagccugccccgcugcuggcugguguccaacggcagcuaccugaacgagacgcacuucuccgacgacaucgagcagcaggccgacaacaugaucaccgagcuccugcagaaggaguacauggaccggcagggcaagaccccgcuggggcucguggaccuguucgucuucagcaccuccuucuaccugaucagcaucuuccugcaccucgugaagaucccgacgcaccgccacaucaucggcaagcccugccccaagccccaccggcugaaccacauggggaucugcuccugcggccuguacaagcacccgggggugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4916 - RNA, 1690 nt, Artificial Sequence
  mRNA product Design1 comprising derived and/or modified sequence from Lassa virus__AIT17428__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgccgccgaccucaagugcuucgggaacaccgccguggcgaagugcaacgagaagcacgacgaggaguucugcgacaugcugcgccuguucgacuucaacaagcaggccaucgagcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggcggaccagccugccccgcugcuggcugguguccaacggcagcuaccugaacgagacccacuucuccgacgacaucgagcagcaggcggacaacaugaucacggagcuccugcagaaggaguacauggaccggcagggcaagaccccgcuggggcucguggaccuguucgucuucagcaccuccuucuaccugaucagcaucuuccugcaccucgugcgcaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4917 - RNA, 1690 nt, Artificial Sequence
  mRNA product Design1 comprising derived and/or modified sequence from Lassa virus__AIT17430__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggccggaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4918 - RNA, 1690 nt, Artificial Sequence
  mRNA product Design1 comprising derived and/or modified sequence from Lassa virus__AIT17438__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacauccgggucggcaacgagaccggccuggagcucacccugaccaacacgagcaucaucucccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaaggagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugaacauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggccgacaacaugaucacggagcuccugcagaaggaguacaucgaccgccagggcaagaccccgcuggggcucguggaccuguucgucuucuccaccagcuucuaccugaucuccaucuuccugcaccucgugaagaucccgacccaccggcacgugaucggcaagcccugccccaagccccaccgccugaaccagauggggaucugcagcugcggccuguacaagcagccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4919 - RNA, 1690 nt, Artificial Sequence
  mRNA product Design1 comprising derived and/or modified sequence from Lassa virus__AIT17442__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcgcauggccuggggcggguccuacaucgcccuggacagcggcaagggguccugggacugcaucaugacgagcuaccaguaccucaucauccagaacaccuccugggaggaccacugccaguucagccggcccagccccaucggcuaccuggggcugcucucccagcgcacccgggacaucuacaucagccgccggcugcugggcaccuucacguggacccucuccgacagcgagggcaacgagacccccgggggcuacugccugacccgcuggaugcugaucgaggccgagcucaagugcuucgggaacacggccguggcgaagugcaacgagaagcacgacgaggaguucugcgacaugcugcggcuguucgacuucaacaagcaggccauccgccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacaccgucaccgggaagacgucccugccccggugcuggcuggugagcaacggcuccuaccugaacgagacccacuucagcgacgacaucgagcagcaggcggacaacaugaucaccgagcuccugcagaaggaguacaucgaccgccagggcaagaccccgcuggggcucguggaccuguucgucuucuccacgagcuucuaccugaucuccaucuuccugcaccucgugaagaucccgacccaccggcacgugaucggcaagcccugccccaagccccaccgcaucaaccacauggggaucugcagcugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4920 - RNA, 1690 nt, Artificial Sequence
  mRNA product Design1 comprising derived and/or modified sequence from Lassa virus__AIT17446__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccucccacugcgggaccgucgccaacggcgugcugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccagccccaucggcuaccuggggcugcucucccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugccccgcugcuggcuggugagcaacggcuccuaccugaacgagacccacuucagcgacgacaucgagcagcaggccgacaacaugaucacggagcuccugcagaaggaguacauggaccggcagggcaagaccccgcuggggcucgucgaccuguucguguucuccaccagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4921 - RNA, 1690 nt, Artificial Sequence
  mRNA product Design1 comprising derived and/or modified sequence from Lassa virus__AIT17450__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacaucaucggcaagcccugccccaagccccaccggcugaaccacauggggaucugcuccugcggccuguacaagcacccgggggugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4922 - RNA, 1690 nt, Artificial Sequence
  mRNA product Design1 comprising derived and/or modified sequence from Lassa virus__AIT17454__GPC (opt1)
gggagaaagcuuaccaugggccagaucaucaccuucuuccaggaggugccccacgucaucgaggaggugaugaacaucgugcugaucgccuucagccuccuggccauccugaaggggaucuacaacgucgcgaccugcggccucuucgggcugguguccuuccugcuccugugcggccgcagcugcuccaccaccuacaaggggguguacgagcugcagacccucgagcuggacauggccagccugaacaugaccaugccgcucuccugcacgaagaacaacagccaccacuacaucauggucggcaacgagaccggccuggagcugacccucaccaacacguccaucaucaaccacaaguucugcaaccugagcgacgcccacaagcggaaccuguacgaccacgcccucauguccaucaucagcaccuuccaccuguccauccccaacuucaaccaguacgaggccaugagcugcgacuucaacgggggcaagaucuccgugcaguacaaccugagccacaccuacgcgguggacgccgccgggcacugcggcaccaucgccaacgggguccuccagacguucaugcgcauggcguggggcggcuccuacaucgcccuggacagcgggaagggcuccugggacugcaucaugaccagcuaccaguaccugaucauccagaacaccaccugggaggaccacugccaguucucccggcccagccccaucggguaccucggccugcugagccagcgcacgcgggacaucuacaucucccgccggcuccugggcaccuucaccuggacccugagcgacuccgaggggaacgagacgccgggcggguacugccucacccgcuggaugcugaucgaggccgagcugaagugcuucggcaacaccgccguggccaagugcaacgagaagcacgacgaggaguucugcgacaugcuccggcuguucgacuucaacaagcaggcgauccgccggcugaagaccgaggcccagaugagcauccagcucaucaacaaggccgugaacgcccugaucaacgaccagcugaucaugaagaaccaccuccgcgacaucauggggauccccuacugcaacuacuccaaguacugguaccugaaccacacgaucaccggcaagaccagccugccccggugcuggcucgucuccaacggcagcuaccugaacgagacccacuucuccgacgacaucgagcagcaggccgacaacaugaucacggagcugcuccagaaggaguacauggaccgccaggggaagacgccccugggccugguggaccucuucguguucagcaccuccuucuaccugaucagcaucuuccugcaccuggucaagaucccgacccaccggcacaucaucgggaagcccugccccaagccccaccgccucaaccacaugggcaucugcuccugcgggcuguacaagcacccgggcgugcccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4923 - RNA, 1690 nt, Artificial Sequence
  mRNA product Design1 comprising derived and/or modified sequence from Lassa virus__AIT17458__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggcaagggguccugggacugcaucaugaccaccuaccaguaccucaucauccagaacaccacgugggaggaccacugccaguucagccgccccucccccaucggcuaccuggggcugcucagccagcggacccgcgacaucuacaucagccggcgccugcugggcaccuucaccuggacgcucuccgacagcgagggcaacgagacccccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagacggaggcccagauguccauccagcugaucaacaaggccgugaacgcccugaucaacgaccagcucaucaugaagaaccaccuccgggacaucaugggcauccccuacugcaacuacagcaaguacugguaccugaaccacaccgugaccgggaagaccucccugccccgcugcuggcuggucagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucguguucuccaccagcuucuaccugaucuccaucuuccugcaccucgucaagaucccgacgcaccgccacgugaucggcaagcccugccccaagccccaccggcugaaccacauggggaucugcagcugcggccuguacaagcacccgggggugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4924 - RNA, 1690 nt, Artificial Sequence
  mRNA product Design1 comprising derived and/or modified sequence from Lassa virus__AIT17462__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugcccaagugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4925 - RNA, 1690 nt, Artificial Sequence
  mRNA product Design1 comprising derived and/or modified sequence from Lassa virus__AIT17466__GPC (opt1)
gggagaaagcuuaccaugggccagaucaucaccuucuuccaggaggugccccaggucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaaccaguccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuucgcgguggacgccgccaaccacugcgggaccaucgccaacggcguccugcagaccuucaugcggauggcguggggcggguccuacaucgcccuggacagcggccgcggguccugggacugcaucaugacgagcuaccaguaccucaucauccagaacaccaccugggaggaccacugccaguucucccggcccagccccaucggcuaccuggggcugcucagccagcgcacccgggacaucuacaucucccgccggcugcugggcacguucaccuggacccucagcgacuccgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccaucacggggaagaccagccugccccggugcuggcuggucuccaacggcagcuaccugaacgagacccacuucuccgacgacaucgagcagcaggccgacaacaugaucaccgagcuccugcagaaggaguacauggaccgccagggcaagacgccccuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4926 - RNA, 1690 nt, Artificial Sequence
  mRNA product Design1 comprising derived and/or modified sequence from Lassa virus__AIT17470__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4927 - RNA, 1690 nt, Artificial Sequence
  mRNA product Design1 comprising derived and/or modified sequence from Lassa virus__AIT17474__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccauccaguacaaccucagccacaccuacgcgguggacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacgaucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacaucacgggcaagcccugccccaagccccaccggcugaaccacauggggaucugcuccugcggccuguacaagcacccggggguccccgugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4928 - RNA, 1690 nt, Artificial Sequence
  mRNA product Design1 comprising derived and/or modified sequence from Lassa virus__AIT17478__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccgaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucagccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggccgacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacgugaucggcaagcccugccccaagccccaccgccucaaccacauggggaucugcagcugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4929 - RNA, 1690 nt, Artificial Sequence
  mRNA product Design1 comprising derived and/or modified sequence from Lassa virus__AIT17482__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaucaccugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggccgagcucaagugcuucgggaacacggccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgucaccgggaagacgagccugccccgcugcuggcugguguccaacggcagcuaccugaacgagacccacuucuccgacgacaucgagcagcaggcggacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacguggucggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4930 - RNA, 1690 nt, Artificial Sequence
  mRNA product Design1 comprising derived and/or modified sequence from Lassa virus__AIT17486__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccgugggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4931 - RNA, 1690 nt, Artificial Sequence
  mRNA product Design1 comprising derived and/or modified sequence from Lassa virus__AIT17490__GPC (opt1)
gggagaaagcuuaccaugggccagaucaucaccuucuuccaggaggugccccacgucaucgaggaggugaugaacaucgugcugaucacccucagccugcuggccauccucaaggggaucuacaacgucgccacgugcggccuguucgggcugguguccuuccuccugcugugcggccgcagcugcuccaccaccuacaaggggguguacgagcuccagacccuggagcuggacauggcgaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuucgccguggacgcggccaaccacugcgggacgaucgccaacggcguccugcagaccuucaugcggauggccuggggcgggagcuacaucgcgcuggacuccggcaaggggagcugggacugcaucaugaccuccuaccaguaccucaucauccagaacaccacgugggaggaccacugccaguucagccgccccucccccaucggcuaccuggggcugcucagccagcggacccgcgacaucuacaucagccggcgccugcugggcaccuucaccuggacgcucuccgacagcgagggcaacgagacccccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagacggaggcgcagauguccauccagcugaucaacaaggccgugaacgcccugaucaacgaccagcucaucaugaagaaccaccuccgggacaucaugggcauccccuacugcaacuacagcaaguacugguaccugaaccacaccgucaccgggaagaccucccugccccgcugcuggcuggugagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucgucuucuccaccagcuucuaccugaucuccaucuuccugcaccucgugaagaucccgacgcaccgccacaucaucggcaagcccugccccaagccccaccggcugaaccacauggggaucugcagcugcggccuguacaagcacccgggggugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4932 - RNA, 1690 nt, Artificial Sequence
  mRNA product Design1 comprising derived and/or modified sequence from Lassa virus__AIT17494__GPC (opt1)
gggagaaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaucuacaagggggucuacgagcuccagacccuggagcuggacauggccagccucaacaugaccaugccgcuguccugcaccaagaacaacagccaccacuacaucauggugggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagaccuucaugcggauggcguggggcggguccuacaucgcccuggacagcggcaagggguccugggacugcaucaugacgagcuaccaguaccucaucauccagaacaccuccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacaccgugaccgggaagacgucccugccccgcugcuggcuggugagcaacggcuccuaccugaacgagacccacuucagcgacgacaucgagcagcaggccgacaacaugaucaccgagcuccugcagaaggaguacaucgaccggcagggcaagaccccgcuggggcucgucgaccuguucguguucuccacgagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4933 - RNA, 1690 nt, Artificial Sequence
  mRNA product Design1 comprising derived and/or modified sequence from Lassa virus__AIT17498__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgagaccgagcucaagugcuucgggaacaccgccguggccaagugcaacgagaagcacgacgaggaguucugcgacaugcugcgccuguucgacuucaacaagcaggccaucucccggcuccgcagcgaggcgcagauguccauccagcugaucaacaaggccgugaacgcccugaucaacgaccagcucaucaugaagaaccaccuccgggacaucaugggcauccccuacugcaacuacagcaaguacugguaccugaaccacacggucaccgggaagaccucccugcccaagugcuggcuggugagcaacggcuccuaccugaacgagacccacuucagcgacgacaucgagcagcaggccgacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacaucacgggcaagcccugccccaagccccaccgccucaaccacauggggaucugcagcugcggccuguacaagcacccgggggugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4934 - RNA, 1690 nt, Artificial Sequence
  mRNA product Design1 comprising derived and/or modified sequence from Lassa virus__AIT17502__GPC (opt1)
gggagaaagcuuaccaugggccagaucaucaccuucuuccaggagaucccccacgugaucgaggaggucaugaacaucgugcugaucacccucagccugcuggccauccucaaggggaucuacaacguggccacgugcggccuguucgggcuggucuccuuccuccugcugugcggcaagagcugcuccaccaccuacaaggggguguacgagcuccagacccuggagcuggacauggcgagccucaacaugacgaugccgcuguccugcaccaagaacaacagccaccacuacaucauggugggcaacgagaccggccuggagcucacccugacgaacaccuccaucaucaaccacaaguucugcaaccugagcgacgcccaccgcaagaaccucuacgaccacacccugauguccaucaucagcaccuuccaccuguccauccccaacuucaaccaguacgaggccaugagcugcgacuucaacgggggcaagaucuccguccaguacaaccucagccacgccuacgccaucgacgcggccacgcacugcgggaccaucgccaacggcgugcugcagaccuucaugcggauggccuggggcggguccuacaucgcgcuggacagcggcaagggcgggugggacugcaucaugaccuccuaccaguaccucaucauccagaacacgaccugggaggaccacugccaguucagccgccccucccccaucggguaccugggccugcucagccagcggacccgcgacaucuacaucagccggcgccugcugggcaccuucacguggacccucuccgacagcgaggggaacgagaccccgggcggguacugccugacccgguggaugcugaucgaggccgagcucaagugcuucggcaacacggccguggccaagugcaacgagaagcacgacgaggaguucugcgacaugcugcgccuguucgacuucaacaagcaggccauccggcgccucaagaccgaggcgcagauguccauccagcugaucaacaaggccgucaacgcccugaucaacgaccagcucaucaugcggaaccaccuccgcgacaucauggggauccccuacugcaacuacagcaaguacugguaccugaaccacaccgugaccggcaagacgucccugcccaagugcuggcuggugagcaacggcuccuaccugaacgagacccacuucagcgacgacaucgagcagcaggccgacaacaugaucaccgagcuccugcagaaggaguacauggaccggcaggggaagacgccccugggccucgucgaccuguucguguucuccaccagcuucuaccugaucuccaucuuccugcaccucgugaagaucccgacccaccgccacgucaucgggaagcccugccccaagccccaccggcugaaccacaugggcgugugcagcugcgggcuguacaagcacccgggcgugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4935 - RNA, 1690 nt, Artificial Sequence
  mRNA product Design1 comprising derived and/or modified sequence from Lassa virus__AIT17506__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccgagcacugcgggaccaucgcgaacggcguccugcagaccuucaugcggauggccuggggcggguccuacaucgcccuggacagcggcaagggguccugggacugcgugaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccaucgagcggcucaagaccgaggcccagaugagcauccagcugaucaacaaggccgucaacgcccugaucaacgaccagcucaucaugaagaaccaccuccgcgacaucaugggcaucccguacugcaacuacuccaaguacugguaccugaaccacaccgugacggggaagaccagccugccccggugcuggcugguguccaacggcagcuaccugaacgagacccacuucuccgacgacaucgagcagcaggcggacaacaugaucaccgagaugcuccagaaggaguacaucgaccgccagggcaagacgccccuggggcuggucgaccucuucguguucagcaccuccuucuaccugaucagcaucuuccugcaccuggugaagaucccgacccaccggcacgucaucggcaagcccugccccaagccccaccgccucaaccacauggggaucugcuccugcggccuguacaagcacccgggggugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4936 - RNA, 1690 nt, Artificial Sequence
  mRNA product Design1 comprising derived and/or modified sequence from Lassa virus__AIT17510__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgaaggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4937 - RNA, 1690 nt, Artificial Sequence
  mRNA product Design1 comprising derived and/or modified sequence from Lassa virus__AIT17514__GPC (opt1)
gggagaaagcuuaccaugggccagaucaucaccuucuuccaggaggugccccacgucaucgaggaggugaugaacaucgugcugaucgcccucagccugcuggccguccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguaccgccacccgggggugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4938 - RNA, 1690 nt, Artificial Sequence
  mRNA product Design1 comprising derived and/or modified sequence from Lassa virus__AIT17518__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4939 - RNA, 1690 nt, Artificial Sequence
  mRNA product Design1 comprising derived and/or modified sequence from Lassa virus__AIT17524__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggugaccgggaagaccagccugccccgcugcuggcuggucuccaacggcagcuaccugaacgagacccacuucuccgacgacaucgagcagcaggccgacaacaugaucacggagaugcuccagaaggaguacauggaccggcagggcaagaccccgcuggggcugguggaccucuucguguucagcaccuccuucuaccugaucagcaucuuccugcaccuggucaagaucccgacccaccgccacgugaucggcaagcccugccccaagccccaccggcucaaccacauggggaucugcuccugcggccuguacaagcacccgggggugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4940 - RNA, 1690 nt, Artificial Sequence
  mRNA product Design1 comprising derived and/or modified sequence from Lassa virus__AIT17528__GPC (opt1)
gggagaaagcuuaccaugggccagaucaucaccuucuuccaggaggugccccacgucaucgaggaggugaugaacaucgugcugaucgcccucagccugcuggccaugcucaaggggaucuacaacaucgcgaccugcggccuguucgggcugaucuccuuccuccugcugugcggccgcagcugcuccacgaccuacaagggggucuacgagcuccaggcccuggagcuggacauggccaaccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggcgauguccugcgacuucaacgggggcaagaucagcgugcaguacaaccucucccacaccuacgccggggacgccgccaagcacugcggcaccaucgcgaacgggguccugcagaccuucaugcggauggccuggggcggcagcuacaucgcccuggacuccgggaagggcaacugggacugcaucaugacgagcuaccaguaccucaucauccagaacaccaccugggaggaccacugccaguucucccgccccagccccaucggguaccugggccugcucucccagcggacccgcgacaucuacaucagccggcgccugcugggcacguucaccuggacccucagcgacuccgaggggaacgagaccccgggcggguacugccugacgcgguggaugcugaucgaggccgagcucaagugcuucggcaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucauggggauccccuacugcaacuacuccaaguacugguaccugaaccacagcgucaccggccgcacgucccugccccggugcuggcuggugagcaacggcuccuaccugaacgagacccaguucagcgacgacaucgagcagcaggcggacaacaugaucaccgagaugcuccagaaggaguacaucgaccgccaggggaagacgccccugggccugguggaccucuucgucuucuccaccagcuucuaccugaucuccaucuuccugcaccugaucaagaucccgacccaccggcacaucguggggaagcccugccccaagccccaccgccucaaccacaugggcaucugcagcugcgggcuguacaagcacccgggcauccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4941 - RNA, 1690 nt, Artificial Sequence
  mRNA product Design1 comprising derived and/or modified sequence from Lassa virus__AIT17538__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacaucgcgaccugcggccuguucgggcugaucuccuuccuccugcugugcggccgcagcugcuccacgaccuacaagggggucuacgagcuccagacccuggagcuggacauggccaaccucaacaugaccaugccgcugagcugcacgaagaacaacucccaccacuacaucauggugggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgaggggaagaucagcgugcaguacaaccucucccacagcuacgcgaucgacgccgccggccacugcgggaccaucgccaacggcguccugcagaccuucaugcggauggcguggggcggguccuacaucgcccuggacagcggcaaggggaacugggacugcaucaugacguccuaccaguaccucaucauccagaacaccaccugggaggaccacugccaguucagccgccccucccccaucggcuaccuggggcugcucagccagcggacccgcgacaucuacaucagccggcgccugcugggcacguucaccuggacccucuccgacagcgagggcaacgaggcccccgggggcuacugccugacccgguggaugcugaucgaggccgagcucaagugcuucgggaacacggccaucgcgaagugcaacgagaagcacgacgaggaguucugcgacaugcugcgccuguucgacuucaacaagcaggccaucaagcggcucaaggccgaggcccagauguccauccaccugaucaacaaggccgugaacgcgcugaucaacgaccagcucaucaugaagaaccaccuccgcgacaucaugggcauccccuacugcaacuacagcaaguacugguaccugaaccacaccgugaccgggaagaccucccugcccaagugcuggcuggucagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucguguucuccaccagcuucuaccugaucuccaucuuccugcaccucgucaagaucccgacgcaccgccacaucgugggccggcccugccccaagccccaccgccugaaccacauggggaucugcagcugcggccuguacaagcacccgggggugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4942 - RNA, 1690 nt, Artificial Sequence
  mRNA product Design1 comprising derived and/or modified sequence from Lassa virus__AIT17540__GPC (opt1)
gggagaaagcuuaccaugggccagaucgugaccuucuuccaggaggucccccacgugaucgaggagaucaugaacaucgugcugaucacccucagccugcuggccauccucaaggggaucuacaacuucgccacgugcggccugaucgggcugaucaccuuccucuuccugugcggccgcuccugcagcaccaucuacaagggguccuaccagcugcagacccucgagcugaacauggagacgcugaacaugaccaugccgcucagcugcaccaagaacaacucccaccacuacauccgggucggcaacgagaccggccuggagcugacgcucaccaacaccagcaucaucaaccacaaguucugcaaccuguccgaggcgcacaagaagaaccuguacgaccacgcccucaugagcaucaucuccaccuuccaccugagcauccccaacuucaaccaguacgaggccauguccugcgacuucaacgggggcaagaucagcgugcaguacaaccugucccacagcuacgccguggacgccgcgaaccacugcgggacggucgccaacggcgugcuccagaccuucaugcgcauggccuggggcggguccuacaucgcccuggacagcggccgggggaacugggacugcaucaugaccuccuaccaguaccugaucauccagaacaccacgugggaggaccacugccaguucagccgccccucccccaucggcuaccucgggcugcugagccagcggacccgcgacaucuacaucagccggcgccuccugggcaccuucaccuggacgcuguccgacagcgagggcaaggagacccccgggggcuacugccucacccgguggaugcugaucgaggcggagcugaagugcuucgggaacaccgccguggccaagugcaacgagaagcacgacgaggaguucugcgacaugcuccgccuguucgacuucaacaagcaggccauccagcggcugaagacggaggcccagauguccauccagcucaucaacaaggcggucaacgcccugaucaacgaccagcugaucaugaagaaccaccuccgcgacaucaugggcauccccuacugcaacuacagcaaguacugguaccugaaccacaccuccaccgggcggaccagccugcccaagugcuggcucguguccaacggcagcuaccugaacgagacgcacuucuccgacgacaucgagcagcaggccgacaacaugaucaccgagaugcugcagaaggaguacaucgaccgccagggcaagaccccgcucgggcugguggaccuguucgucuucagcaccuccuucuaccucaucagcaucuuccugcaccuggugaagaucccgacgcaccggcacaucgugggcaaguccugccccaagccccaccgccugaaccacauggggaucugcagcugcggccucuacaagcagcccggggucccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4943 - RNA, 1690 nt, Artificial Sequence
  mRNA product Design1 comprising derived and/or modified sequence from Lassa virus__AIT17544__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugggcagccucaacaugaccaugccgcuguccugcacgaagaacaacagccaccacuacaucauggucggcaacgagaccgggcuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacggcgggaagaucuccgugcaguacaaccucagccacuccuacgccguggacgcggccaaccacugcggcaccaucgccaacgggguccugcagaccuucaugcggauggccuggggcggcagcuacaucgcgcuggacuccgggaagggcagcugggacugcaucaugacguccuaccaguaccucaucauccagaacaccaccugggaggaccacugccaguucagccgccccagccccaucggguaccugggccugcucucccagcggacccgcgacaucuacaucagccggcgccugcugggcacguucaccuggacccucuccgacagcgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggccauccggcgccucaagaccgaggcgcagauguccauccagcugaucaacaaggccgugaacgcccugaucaacgaccagcucaucaugaagaaccaccuccgggacaucauggggauccccuacugcaacuacagcaaguacugguaccugaaccacaccgucacgggcaagaccucccugccccgcugcuggcuggugagcaacggcuccuaccugaacgagacccacuucagcgacgacaucgagcagcaggccgacaacaugaucaccgagcuccugcagaaggaguacauggaccggcaggggaagacgccccugggccucguggaccuguucgucuucuccaccagcuucuaccugaucuccaucuuccugcaccucgugaagaucccgacccaccgccacaucaucgggaagcccugccccaagccccaccggcugaaccacaugggcaucugcagcugcgggcuguacaagcacccgggcgugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4944 - RNA, 1690 nt, Artificial Sequence
  mRNA product Design1 comprising derived and/or modified sequence from Lassa virus__AIT17548__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccucuuccugugcggccgcagcugcuccacgaccuacaaggggguguacgagcugcagacccucgagcuggacauggccagccugaacaugaccaugccgcucuccugcacgaagaacaacagccaccacuacaucauggucggcaacgagaccggccuggagcugacccucaccaacacguccaucaucaaccacaaguucugcaaccugagcgacgcccacaagcggaaccuguacgaccacgcccucauguccaucaucagcaccuuccaccuguccauccccaacuucaaccaguacgaggccaugagcugcgacuucaacgggggcaagaucuccgugcaguacaaccugagccacgcguacgccggggacgccgccaagcacugcggcaccaucgcgaacggggugcuccagaccuucaugcgcauggccuggggcggcuccuacaucgcccuggacagcgggaagggcuccugggacugcaucaugacgagcuaccaguaccugaucauccagaacaccaccugggaggaccacugccaguucucccggcccagccccaucggguaccucggccugcugagccagcgcacccgggacaucuacaucucccgccggcuccugggcacguucaccuggacccugagcgacuccgaggggaacgagaccccgggcggguacugccucacgcgcuggaugcugaucgaggccgagcugaagugcuucggcaacaccgccgucgcgaagugcaacgagaagcacgacgaggaguucugcgacaugcuccggcuguucgacuucaacaagcaggccauccgccggcugcgcaccgaggcccagaugagcauccagcucaucaacaaggccgugaacgcccugaucaacgaccagcugaucaugaagaaccaccuccgggacaucauggggauccccuacugcaacuacuccaaguacugguaccugaaccacaccgugacgggcaagaccagccugcccaagugcuggcucgucuccaacggcagcuaccugaacgagacccacuucuccgacgacaucgagcagcaggcggacaacaugaucaccgagaugcugcagaaggaguacaucgaccgccaggggaagacgccccucggccugguggaccuguucguguucagcaccuccuucuaccucaucagcaucuuccugcaccuggucaagaucccgacccaccggcacgugaucgggaagcccugccccaagccccaccgccugaaccacaugggcaucugcuccugcgggcucuacaagcacccgggcgugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4945 - RNA, 1690 nt, Artificial Sequence
  mRNA product Design1 comprising derived and/or modified sequence from Lassa virus__AIT17552__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccgugaacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4946 - RNA, 1690 nt, Artificial Sequence
  mRNA product Design1 comprising derived and/or modified sequence from Lassa virus__AIT17556__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggccgcggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacgaucaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacaucacgggcaagcccugccccaagccccaccgccugaaccacauggggaucugcuccugcggccuguacaagcacccgggggugcccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4947 - RNA, 1690 nt, Artificial Sequence
  mRNA product Design1 comprising derived and/or modified sequence from Lassa virus__AIT17560__GPC (opt1)
gggagaaagcuuaccaugggccagaucaucaccuucuuccaggaggugccccacgucaucgaggaggugaugaacaucgugcugaucgcccucagccugcuggccguccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaccaacaacagccaccacuacaucauggugggcaacgagaccggccuggagcucacccugacgaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccggggaggccgccaaccacugcggcaccaucgcgaacgggguccugcagacguucaugcggauggccuggggcggcuccuacaucgcccuggacagcgggaagggcuccugggacugcaucaugaccagcuacaaguaccucaucauccagaacaccaccuggggcgaccacugccaguucucccgccccagccccaucggguaccugggccugcucagccagcggacgcgcgacaucuacaucucccggcgccugcuggggaccuucaccuggacccucagcgacuccgagggcaacgagacgcccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccauccggaagcucaagaccgaggcccagaugagcauccagcugaucaacaaggccgugaacgcccugaucaacgaccagcucaucaugaagaaccaccuccgcgacaucaugggcauccccuacugcaacuacucccgguacugguaccugaaccacacggucaccggccgcaccagccugccccggugcuggcugguguccaacgggagcuaccugaacgagacccacuucuccgacgacaucgagcagcaggcggacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggcgugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4948 - RNA, 1690 nt, Artificial Sequence
  mRNA product Design1 comprising derived and/or modified sequence from Lassa virus__AIT17564__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugcucuccuuccugcugcucugcggccgcagcugcuccacgaccuacaaggggguguacgagcugcagacccuggagcucgacauggccagccugaacaugaccaugccgcuguccugcacgaagaacaacagccaccacuacaucauggugggcaacgagaccggccucgagcugacccugaccaacacguccaucaucaaccacaaguucugcaaccucagcgacgcccacaagaaggaccuguacgaccacgcccugauguccaucaucagcaccuuccaccucuccauccccaacuucaaccaguacgaggccaugagcugcgacuucaacgggggcaagaucuccguccaguacaaccugagccacgcguacgccguggacgccgccaagcacugcgggaccaucgcgaacggcgugcugcagaccuucaugcggauggccuggggcggguccuacaucgcccucgacagcggcaagggguccugggacugcaucaugacgagcuaccaguaccugaucauccagaacaccuccugggaggaccacugccaguucagccgccccagccccaucggcuaccuggggcuccugucccagcggacccgcgacaucuacaucagccggcgccugcucggcaccuucacguggacccuguccgacagcgagggcaacgagacccccgggggcuacugccugacccgguggaugcucaucgaggccgagcugaagugcuucgggaacacggccgucgcgaagugcaacgagaagcacgacgaggaguucugcgacaugcugcgccucuucgacuucaacaagcaggccaucaagcggcugaagaccgaggcccagauguccauccagcugaucaacaaggccgugaacgcccucaucaacgaccagcugaucaugaagaaccaccuccgcgacaucaugggcauccccuacugcaacuacagcaaguacugguaccugaaccacaccgugaccgggaagacgucccugccccggugcuggcuggucagcaacggcuccuaccucaacgagacccacuucagcgacgacaucgagcagcaggcggacaacaugaucaccgagcugcugcagaaggaguacaucgaccgccagggcaagaccccgcucgggcugguggaccuguucguguucuccacgagcuucuaccugaucuccaucuuccuccaccuggucaagaucccgacccaccggcacgugaucggcaagcccugccccaagccccaccgccugaaccacauggggaucugcagcugcggccucuacaagcacccgggggugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4949 - RNA, 1690 nt, Artificial Sequence
  mRNA product Design1 comprising derived and/or modified sequence from Lassa virus__AIT17572__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaacuacgcgguggacgccgccaaccacugcgggaccaucgccaacggcguccugcagaccuucaugcggauggcguggggcgggagcuacaucgcccuggacuccggcaaggggaacugggacugcaucaugacgagcuaccaguaccucaucauccagaacaccaccugggaggaccacugccaguucucccgccccagccccaucggcuaccuggggcugcucucccagcggacccgcgacaucuacaucagccggcgccugcugggcacguucaccuggacccucagcgacuccgagggcaacgacaugcccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagaugaacauccagcugaucaacaaggccgugaacgcccugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacaucaucggcaagcccugccccaagccccaccggcugaaccacauggggaucugcagcugcggccuguacaagcacccgggggugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4950 - RNA, 1690 nt, Artificial Sequence
  mRNA product Design1 comprising derived and/or modified sequence from Lassa virus__AIT17576__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucucccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagaugcuccagaaggaguacaucgaccgccagggcaagaccccgcuggggcugguggaccucuucgucuucagcaccuccuucuaccugaucagcaucuuccugcaccuggugaagaucccgacccaccggcacaucacgggcaagcccugccccaagccccaccgccucaaccacauggggaucugcuccugcggccuguacaagcacccgggggugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4951 - RNA, 1690 nt, Artificial Sequence
  mRNA product Design1 comprising derived and/or modified sequence from Lassa virus__AIT17580__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagagcaacgagacgccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggcgauccggcgccucaaggccgaggcccagauguccauccagcugaucaacaaggccgugaacgcccugaucaacgaccagcucaucaugaagaaccaccuccgggacaucauggggauccccuacugcaacuacagcaaguacugguaccugaaccacaccgucacgggccgcaccucccugccccggugcuggcuggugagcaacggguccuaccugaacgagacccacuucagcgacgacaucgagcagcaggcggacaacaugaucaccgagcuccugcagaaggaguacauggaccgccagggcaagacgccccugggccucguggaccuguucgucuucuccaccagcuucuaccugaucuccaucuuccugcaccucgugaagaucccgacccaccggcacgugaucgggaagcccugccccaagccccaccgccugaaccacaugggcaucugcagcugcgggcuguacaagcacccgggcguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4952 - RNA, 1690 nt, Artificial Sequence
  mRNA product Design1 comprising derived and/or modified sequence from Lassa virus__AIT17584__GPC (opt1)
gggagaaagcuuaccaugggccagaucaucaccuucuuccaggaggugccccaggucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaaccaguccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacuccuucgcgguggacgccgccaaccacugcgggaccaucgccaacggcguccugcagaccuucaugcggauggcguggggcgggagcuacaucgcccuggacuccggcaaggggagcugggacugcaucaugaccuccuaccaguaccucaucauccagaacacgaccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucaugggcauccccuacugcaacuacagcaaguacugguaccugaaccacaccaagaccgggaagacgucccugccccgcugcuggcuggucagcaacggcuccuaccugaacgagacccacuucagcgacgacaucgagcagcaggccgacaacaugaucaccgagcuccugcagaaggaguacauggaccggcagggcaagaccccgcuggggcucguggaccuguucguguucuccacgagcuucuaccugaucuccaucuuccugcaccucgucaagaucccgacccaccgccacgugaucggcaagcccugccccaagccccaccggcugaaccacauggggaucugcagcugcggccuguacaagcacccgggggugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4953 - RNA, 1690 nt, Artificial Sequence
  mRNA product Design1 comprising derived and/or modified sequence from Lassa virus__AIT17588__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaaggccgaggcccagaugagcauccagcugaucaacaaggccgugaacgcgcugaucaacgaccagcucaucaugaagaaccaccuccgggacaucaugggcauccccuacugcaacuacuccaaguacugguaccugaaccacaccgucaccgggaagacgagccugccccgcugcuggcugguguccaacggcagcuaccugaacgagacccacuucuccgacgacaucgagcagcaggccgacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4954 - RNA, 1690 nt, Artificial Sequence
  mRNA product Design1 comprising derived and/or modified sequence from Lassa virus__AIT17592__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacacccugauguccaucaucagcaccuuccaccuguccauccccaacuucaaccaguacgaggccaugagcugcgacuucaacgggggccggaucuccgugcaguacaaccucagccacgccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacgaucaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacguggugggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4955 - RNA, 1690 nt, Artificial Sequence
  mRNA product Design1 comprising derived and/or modified sequence from Lassa virus__AIT17596__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccuccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucaugggcaucccguacugcaacuacagcaaguacugguaccugaaccacaccgucacggggaagaccucccugccccgcugcuggcuggugagcaacggcuccuaccugaacgagacccacuucagcgacgacaucgagcagcaggccgacaacaugaucaccgagcuccugcagaaggaguacaucgaccggcagggcaagacgccccuggggcucguggaccuguucgucuucuccaccagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4956 - RNA, 1690 nt, Artificial Sequence
  mRNA product Design1 comprising derived and/or modified sequence from Lassa virus__AIT17600__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccggggacgccgccaaccacugcggcaccaucgcgaacggggugcugcagaccuucaugcggauggccuggggcggcuccuacaucgcccuggacagcgggaagggcuccugggacugcaucaugacgagcuaccaguaccucaucauccagaacaccaccugggaggaccacugccaguucucccgccccagccccaucggguaccugggccugcucagccagcggacccgcgacaucuacaucucccggcgccugcugggcacguucaccuggacccucagcgacuccgaggggaacgagaccccgggcggguacugccugacgcgguggaugcugaucgaggccgagcucaagugcuucggcaacaccgccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucauggggauccccuacugcaacuacuccaaguacugguaccugaaccacaccgugacgggcaagaccagccugccccgcugcuggcuggucuccaacggcagcuaccugaacgagacccacuucuccgacgacaucgagcagcaggcggacaacaugaucaccgagcuccugcagaaggaguacaucgaccggcaggggaagacgccccugggccucguggaccuguucguguucagcaccuccuucuaccugaucagcaucuuccugcaccucgucaagaucccgacccaccgccacgugaucgggaagcccugccccaagccccaccggcugaaccacaugggcaucugcuccugcgggcuguacaagcacccgggcgugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4957 - RNA, 1690 nt, Artificial Sequence
  mRNA product Design1 comprising derived and/or modified sequence from Lassa virus__AIT17604__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccagccucaacaugacgaugccgcuguccugcaccaagaacaacagccaccacuacaucauggucggcaacgagaccggccuggagcucacccugacgaacaccuccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgccguggacgcggccaagcacugcgggacgaucgccaacggcguccugcagaccuucaugcggauggccuggggcggguccuacaucgcgcuggacagcggcaagggguccugggacugcaucaugaccagcuaccaguaccucaucauccagaacaccacgugggaggaccacugccaguucucccgccccagccccgugggcuaccuggggcugcucagccagcggacccgcgacaucuacaucucccggcgccugcugggcaccuucaccuggacgcucagcgacuccgagggcaacgagacccccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagacggaggcgcagaugagcauccagcugaucaacaaggccgucaacgcccugaucaacgaccagcucaucaugaagaaccaccuccgggacaucaugggcauccccuacugcaacuacuccaaguacugguaccugaaccacaccgugaccgggaagaccagccugccccgcugcuggcugguguccaacggcagcuaccugaacgagacgcacuucuccgacgacaucgagcagcaggccgacaacaugaucaccgagcuccugcagaaggaguaccuggaccggcagggcaagaccccgcucgggcuggucgaccuguucguguucagcaccuccuucuaccugaucagcaucuuccuccaccuggugaagaucccgacgcaccgccacgucaucggcaagcccugccccaagccccaccggcugaaccacauggggaucugcuccugcggccucuacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4958 - RNA, 1690 nt, Artificial Sequence
  mRNA product Design1 comprising derived and/or modified sequence from Lassa virus__AIT17608__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacaaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggcggcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4959 - RNA, 1690 nt, Artificial Sequence
  mRNA product Design1 comprising derived and/or modified sequence from Lassa virus__AIT17612__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacauccgggucggcaacgagaccggccuggagcucacccugaccaacacguccaucaucaaccacaaguucugcaaccugagcgacgcccacaagaagaaccucuacgaccacucccugaugagcaucaucuccaccuuccaccugagcauccccaacuucaaccaguacgaggccauguccugcgacuucaacgggggcaagaucagcgugcaguacaaccucucccacaccuacgccguggacgcggccaaccacugcgggaccaucgccaacggcguccugcagacguucaugcgcauggccuggggcgggagcuacaucgcgcuggacuccggcaaggggaacugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggccauccgccggcucaagaccgaggcgcagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacguggucggcaagcccugccccaagccccaccgccugaaccacauggggaucugcuccugcggccuguacaagcacccgggggugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4960 - RNA, 1690 nt, Artificial Sequence
  mRNA product Design1 comprising derived and/or modified sequence from Lassa virus__AIT17616__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacaucgaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4961 - RNA, 1690 nt, Artificial Sequence
  mRNA product Design1 comprising derived and/or modified sequence from Lassa virus__AIT17620__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucagccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacgcguacgccaucgacgccgccaaccacugcgggaccguggcgaacggcguccugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaaggccgaggcccagauguccauccagcugaucaacaaggccgugaacgcgcugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4962 - RNA, 1690 nt, Artificial Sequence
  mRNA product Design1 comprising derived and/or modified sequence from Lassa virus__AIT17626__GPC (opt1)
gggagaaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucauccagcacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucaccgugcaguacaaccucucccacagcuacgcgaucgacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggcgcaccagccugccccggugcuggcugguguccaacggcagcuaccugaacgagacccacuucuccgacgacaucgagcagcaggccgacaacaugaucacggagcuccugcagaaggaguacauggaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacaugggggugugcuccugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4963 - RNA, 1690 nt, Artificial Sequence
  mRNA product Design1 comprising derived and/or modified sequence from Lassa virus__AIT17630__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugcucuccuuccugcugcucugcggccgcagcugcuccacgaccuacaaggggguguacgagcugcagacccuggagcucgacauggccagccugaacaugaccaugccgcuguccugcacgaagaacaacagccaccacuacaucauggugggcaacgagaccggccucgagcugacccugaccaacacguccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacgcguacgccguggacgccgccgagcacugcgggaccaucgcgaacggcgugcugcagaccuucaugcggauggccuggggcggguccuacaucgcccucgacagcggcaagggguccugggacugcgucaugacgagcuaccaguaccugaucauccagaacaccuccugggaggaccacugccaguucagccgccccagccccaucggcuaccuggggcuccugucccagcggacccgcgacaucuacaucagccggcgccugcucggcaccuucacguggacccuguccgacagcgagggcaacgagacccccgggggcuacugccugacccgguggaugcucaucgaggccgagcugaagugcuucgggaacacggccguggcgaagugcaacgagaagcacgacgaggaguucugcgacaugcugcgccucuucgacuucaacaagcaggccauccggcgccugaagaccgaggcccagauguccauccagcugaucaacaaggccgugaacgcccucaucaacgaccagcugaucaugaagaaccaccuccgggacaucaugggcauccccuacugcaacuacagcaaguacugguaccugaaccacaccgucaccgggaagacgucccugccccgcugcuggcuggugagcaacggcuccuaccucaacgagacccacuucagcgacgacaucgagcagcaggcggacaacaugaucaccgagcugcugcagaaggaguacaucgaccggcagggcaagaccccgcucgggcugguggaccuguucgucuucuccacgagcuucuaccugaucuccaucuuccuccaccuggugaagaucccgacccaccgccacgugaucggcaagcccugccccaagccccaccggcugaaccacauggggaucugcagcugcggccucuacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4964 - RNA, 1690 nt, Artificial Sequence
  mRNA product Design1 comprising derived and/or modified sequence from Lassa virus__AIT17634__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaucuacaaggacguguacgagcuccagacccuggagcuggacauggccagccucaacaugaccaugccgcuguccugcaccaagaacaacagccaccacuacaucauggucgggaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacggcgggaagaucuccgugcaguacaaccucagccacaccuacgcgaucgacgccgccaaccacugcggcaccaucgccaacggggugcugcagaccuucaugcggauggcguggggcggguccuacaucgcccuggacagcggcaagggcuccugggacugcaucaugacgagcuaccaguaccucaucauccagaacaccaccugggaggaccacugccaguucucccgccccagccccaucggguaccugggccugcucagccagcggacccgcgacaucuacaucucccggcgccugcuggggacguucaccuggacccucagcgacuccgagggcaacgagaccccgggcggguacugccugacgcgguggaugcugaucgaggccgagcucaagugcuucggcaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucauggggauccccuacugcaacuacucccgcuacugguaccugaaccacaccgugacgggccggaccagccugccccgcugcuggcuggucuccaacgggagcuaccugaacgagacccacuucuccgacgacaucgagcagcaggccgacaacaugaucaccgagcuccugcagaaggaguacauggaccggcagggcaagacgccccugggccucguggaccuguucguguucagcaccuccuucuaccugaucagcaucuuccugcaccucgucaagaucccgacccaccgccacgugaucgggaagcccugccccaagccccaccggcugaaccacaugggcaucugcuccugcgggcuguacaaccacccgggcgugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4965 - RNA, 1690 nt, Artificial Sequence
  mRNA product Design1 comprising derived and/or modified sequence from Lassa virus__AIT17638__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucaucaagaucccgacccaccgccacaucacgggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4966 - RNA, 1690 nt, Artificial Sequence
  mRNA product Design1 comprising derived and/or modified sequence from Lassa virus__AIT17642__GPC (opt1)
gggagaaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgacaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccgucgacgccgccucccacugcgggaccaucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggaagaccucccugccccgcugcuggcuggugagcaacggcuccuaccugaacgagacccacuucagcgacgacaucgagcagcaggcggacaacaugaucaccgagcuccugcagaaggaguacauggaccggcagggcaagacgccccuggggcucgucgaccuguucguguucuccaccagcuucuaccugaucuccaucuuccugcaccucgugaagaucccgacccaccgccacaucaucggcaagcccugccccaagccccaccggcugaaccacauggggaucugcagcugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4967 - RNA, 1690 nt, Artificial Sequence
  mRNA product Design1 comprising derived and/or modified sequence from Lassa virus__AIT17646__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccucccacugcgggaccgucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggaagaccucccugccccgcugcuggcuggugagcaacggcuccuaccugaacgagacccacuucagcgacgacaucgagcagcaggcggacaacaugaucaccgagcuccugcagaaggaguacauggaccggcagggcaagacgccccuggggcucgucgaccuguucguguucuccaccagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4968 - RNA, 1690 nt, Artificial Sequence
  mRNA product Design1 comprising derived and/or modified sequence from Lassa virus__AIT17650__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacaucuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaaggccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgucaccgggcgcacgagccugccccggugcuggcugguguccaacggcagcuaccugaacgagacccacuucuccgacgacaucgagcagcaggcggacaacaugaucaccgagcuccugcagaaggaguacaucgaccgccagggcaagaccccgcuggggcucguggaccuguucgucuucagcacguccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4969 - RNA, 1690 nt, Artificial Sequence
  mRNA product Design1 comprising derived and/or modified sequence from Lassa virus__AIT17658__GPC (opt1)
gggagaaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccaucacguacaagggggucuacgagcuccagacccuggagcuggacauggccaaccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcgugcaguacaaccucucccacaccuacgcgggggacgccgccgaccacugcggcaccaucgccaacgggguccugcagaccuucaugcggauggcguggggcggcagcuacaucgcccuggacuccgggaagggcagcugggacugcaucaugacguccuaccaguaccucaucauccagaacaccaccugggaggaccacugccaguucagccgccccucccccaugggguaccugggccugcucagccagcggacccgcgacaucuacaucagccggcgccugcugggcacguucaccuggacccucuccgacagcgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucauggggauccccuacugcaacuacagcaaguacugguaccugaaccacaccaucacgggcaagaccucccugccccgcugcuggcuggucagcaacggcuccuaccugaacgagacccacuucagcgacgacaucgagcagcaggccgacaacaugaucaccgagcuccugcagaaggaguacaucgaccggcaggggaagacgccccugggccucguggaccuguucguguucuccaccagcuucuaccugaucuccaucuuccugcaccucgucaagaucccgacccaccgccacaucaccgggaagcccugccccaagccccaccggcugaaccacaugggcaucugcagcugcgggcuguacaagcacccgggcgugcccgugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4970 - RNA, 1690 nt, Artificial Sequence
  mRNA product Design1 comprising derived and/or modified sequence from Lassa virus__AIT17666__GPC (opt1)
gggagaaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucgucgaccuguucguguucagcaccuccuucuaccugaucagcaucuuccugcaccucgugaagaucccgacccaccgccacaucacgggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4971 - RNA, 1690 nt, Artificial Sequence
  mRNA product Design1 comprising derived and/or modified sequence from Lassa virus__AIT17670__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaaggccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggcgcaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4972 - RNA, 1690 nt, Artificial Sequence
  mRNA product Design1 comprising derived and/or modified sequence from Lassa virus__AIT17674__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacaaccacgcccugaugagcaucaucuccaccuuccaccugagcauccccaacuucaaccaguacgaggccauguccugcgacuucaacgggggcaagaucagcgugcaguacaaccucucccacagcuacgccguggacgcggccaaccacugcgggaccaucgccaacggcguccugcagacguucaugcggauggccuggggcggguccuacaucgcgcuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagaccgaggcgcaggccaacauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4973 - RNA, 1690 nt, Artificial Sequence
  mRNA product Design1 comprising derived and/or modified sequence from Lassa virus__AIT17678__GPC (opt1)
gggagaaagcuuaccaugggccagaucaucaccuucuuccaggaggugccccacgucaucgaggaggugaugaacaucgugcugaucacccucagccugcuggccauccucaaggggaucuacaacaucgccacgugcggccuguucgggcuggucuccuuccuccugcugugcggccgcagcugcuccaccaccuacaaggggguguacgagcuccagacccuggagcuggacaugacgagccucaacaugaccaugccgcuguccugcaccaagaacaacagccaccacuacaucauggugggcaacgagaccggccuggagcucacgcugaccaacaccuccaucaucaaccacaaguucugcaaccugagcgacgcgcacaagaagaaccucuacgaccacgcccugauguccaucaucagcaccuuccaccuguccauccccaacuucaaccaguacgaggccaugagcugcgacuucaacgggggcaagaucuccguccaguacaaccucagccacacguacgccguggacgccgcgaaccacugcgggaccaucgccaacggcgugcugcagaccuucaugcggauggccuggggcggguccuacaucgcccuggacagcggcaagggguccugggacugcaucaugaccagcuaccaguaccucaucauccagaacacgaccugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggcggagcucaagugcuucgggaacacggccgucgccaagugcaacgagaagcacgacgaggaguucugcgacaugcugcgccuguucgacuucaacaagcaggccauccggcgccucaagaccgaggcccagaugagcauccagcugaucaacaaggcggugaacgcccugaucaacgaccagcucaucaugaagaaccaccuccgggacaucaugggcauccccuacugcaacuacuccaaguacugguaccugaaccacaccgugaccgggaagacgagccugccccgcugcuggcuggucuccaacggcagcuaccugaacgagacccacuucuccgacgacaucgagcagcaggccgacaacaugaucaccgagcuccugcagaaggaguacaucgaccggcagggcaagaccccgcuggggcucguggaccuguucguguucagcacguccuucuaccugaucagcaucuuccugcaccucgucaagaucccgacccaccgccacaucaucggcaagcccugccccaagccccaccggcugaaccacauggggaucugcuccugcggccuguacaagcacccggggauccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4974 - RNA, 1690 nt, Artificial Sequence
  mRNA product Design1 comprising derived and/or modified sequence from Lassa virus__AIT17686__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaccaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagccgcaagggcuccugggacugcaucaugaccagcuaccaguaccucaucauccagaacaccaccugggaggaccacugccaguucucccggcccagccccaucggguaccugggccugcucagccagcgcacgcgggacaucuacaucucccgccggcugcuggggaccuucaccuggacccucagcgacuccgagggcaacgagacgccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucauggggauccccuacugcaacuacuccaaguacugguaccugaaccacacggucaccggcaagaccagccugccccggugcuggcugguguccaacgggagcuaccugaacgagacccacuucuccgacgacaucgagcagcaggccgacaacaugaucacggagcuccugcagaaggaguacauggaccgccagggcaagacgccccugggccucguggaccuguucgucuucagcaccuccuucuaccugaucagcaucuuccugcaccucaucaagaucccgacccaccggcacgugaucgggaagcccugccccaagccccaccgccugaaccacaugggcaucugcuccugcgggcuguacaagcacccgggcgugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4975 - RNA, 1690 nt, Artificial Sequence
  mRNA product Design1 comprising derived and/or modified sequence from Lassa virus__AIT17690__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccucccacugcgggaccgucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggcgcaccucccugccccggugcuggcuggugagcaacggcuccuaccugaacgagacccacuucagcgacgacaucgagcagcaggcggacaacaugaucaccgagcuccugcagaaggaguacauggaccgccagggcaagacgccccuggggcucgucgaccuguucguguucuccaccagcuucuaccugaucuccaucuuccugcaccucgugaagaucccgacccaccggcacgucaucggcaagcccugccccaagccccaccgccugaaccacauggggaucugcagcugcggccuguacaagcacccgggggugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4976 - RNA, 1690 nt, Artificial Sequence
  mRNA product Design1 comprising derived and/or modified sequence from Lassa virus__AIT17694__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaucuacaaggggguguacgagcuccagacccuggagcuggacauggccagccucaacaugaccaugccgcuguccugcaccaagaacaacagccaccacuacaucauggucggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggccgacaacaugaucaccgagcuccugcagaaggaguacaucgaccggcagggcaagacgccccuggggcucguggaccuguucgucuucagcaccuccuucuaccugaucagcaucuuccugcaccucgugaagaucccgacccaccgccacguggucggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4977 - RNA, 1690 nt, Artificial Sequence
  mRNA product Design1 comprising derived and/or modified sequence from Lassa virus__AIT17712__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggggccugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccaucaugcggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggcggacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacgugaucggcaagcccugccccaagccccaccgccucaaccacauggggaucugcagcugcggccuguacaagcacccggggguccccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4978 - RNA, 1690 nt, Artificial Sequence
  mRNA product Design1 comprising derived and/or modified sequence from Lassa virus__AIT17718__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacauccgggucggcaacgagaccggccuggagcucacccugaccaacgccuccaucaucaaccacaaguucugcaaccugagcgacgcccacaagaagaaccucuacgaccacgcccugauguccaucaucagcacguuccaccuguccauccccaacuucaaccaguacgaggcgaugagcugcgacuucaacgggggcaagaucuccgugcaguacaaccucagccacgccuacgccaucgacgccgcgaaccacugcgggaccguggccaacggcguccugcagaccuucaugcgcauggccuggggcggguccuacaucgcccuggacagcggccgggggaacugggacugcaucaugaccuccuaccaguaccucaucauccagaacacgaccugggaggaccacugccaguucagccgccccucccccaucggcuaccuggggcugcucagccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggcgguggccaagugcaacgagaagcacgacgaggaguucugcgacaugcugcgccuguucgacuucaacaagcaggccauccggcgccucaagaccgaggcccagauguccauccagcugaucaacaaggccgugaacgcgcugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggcuucuacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4979 - RNA, 1690 nt, Artificial Sequence
  mRNA product Design1 comprising derived and/or modified sequence from Lassa virus__AIT17724__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgguggacgccgccaaccacugcgggaccgucgccaacggcgugcugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugccccgcugcuggcuggugagcaacggcuccuaccugaacgagacccacuucagcgacgacaucgagcagcaggccgacaacaugaucacggagcuccugcagaaggaguacauggaccggcagggcaagaccccgcuggggcucgucgaccuguucguguucuccaccagcuucuaccugaucuccaucuuccugcaccucgugaagaucccgacccaccgccacaucaugggcaagcccugccccaagccccaccggcugaaccacauggggaucugcagcugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4980 - RNA, 1690 nt, Artificial Sequence
  mRNA product Design1 comprising derived and/or modified sequence from Lassa virus__AIT17728__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaccaccuacaaggggguguacgagcuccagacccuggagcuggacaugggcagccucaacaugaccaugccgcuguccugcacgaagaacaacagccaccacuacaucauggucggcaacgagaccgggcuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacggcgggaagaucuccgugcaguacaaccucagccacaccuacgccguggacgcggccaaccacugcggcaccaucgccaacgggguccugcagacguucaugcggauggccuggggcggcuccuacaucgcgcuggacagcgggaagggcuccugggacugcaucaugaccagcuaccaguaccucaucauccagaacaccaccugggaggaccacugccaguucucccgccccagccccaucggguaccugggccugcucagccagcggacgcgcgacaucuacaucucccggcgccugcugggcaccuucaccuggacccucagcgacuccgaggggaacgagacgccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccggcgccucaagaccgaggcgcagaugagcauccagcugaucaacaaggccgugaacgcccugaucaacgaccagcucaucaugaagaaccaccuccgggacaucauggggauccccuacugcaacuacuccaaguacugguaccugaaccacacggucaccggcaagaccagccugccccgcugcuggcugguguccaacggcagcuaccugaacgagacccacuucuccgacgacaucgagcagcaggccgacaacaugaucacggagcuccugcagaaggaguacauggaccggcaggggaagacgccccugggccucguggaccuguucgucuucagcaccuccuucuaccugaucagcaucuuccugcaccucgugaagaucccgacccaccgccacgugaucgggaagcccugccccaagccccaccggcugaaccacaugggcaucugcuccugcgggcuguacaagcacccgggcguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4981 - RNA, 1690 nt, Artificial Sequence
  mRNA product Design1 comprising derived and/or modified sequence from Lassa virus__AIT17732__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacaucgugggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4982 - RNA, 1690 nt, Artificial Sequence
  mRNA product Design1 comprising derived and/or modified sequence from Lassa virus__AIT17736__GPC (opt1)
gggagaaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaugcggcucaagaccgaggcccagaugagcauccagcugaucaacaaggccgucaacgcccugaucaacgaccagcucaucaugaagaaccaccuccgcgacaucaugggcauccccuacugcaacuacuccaaguacugguaccugaaccacacggugaccgggaagaccagccugccccggugcuggcugguguccaacggcagcuaccugaacgagacccgcuucuccgacgacaucgagcagcaggccgacaacaugaucacggagaugcuccagaaggaguaccuggaccggcagggcaagaccccgcuggggcucgucgaccuguucguguucagcaccuccuucuaccugaucagcaucuuccugcaccucgugaagaucccgacccaccgccacaucaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4983 - RNA, 1690 nt, Artificial Sequence
  mRNA product Design1 comprising derived and/or modified sequence from Lassa virus__AIT17744__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugauguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggugggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacgcguacgccguggacgccgccaaccacugcgggaccaucgcgaacggcgugcugcagaccuucaugcggauggccuggggcgggagcuacaucgcccuggacuccggcaaggggagcugggacugcaucaugacguccuaccaguaccucaucauccagaacaccagcugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggccgagcucaagugcuucgggaacacggccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgugaccgggaagacgagccugccccgcugcuggcuggucuccaacggcagcuaccugaacgagacccacuucuccgacgacaucgagcagcaggcggacaacaugaucaccgagcuccugcagaaggaguacaucgaccggcagggcaagaccccgcuggggcucguggaccuguucguguucagcacguccuucuaccugaucagcaucuuccugcaccucgucaagaucccgacccaccgccacgugaucggcaagcccugccccaagccccaccggcugaaccacauggggaucugcuccugcggccuguacaagcacccgggggugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4984 - RNA, 1690 nt, Artificial Sequence
  mRNA product Design1 comprising derived and/or modified sequence from Lassa virus__AIT17752__GPC (opt1)
gggagaaagcuuaccaugggccagaucaucaccuucuuccacgaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggccgcggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccgucgccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggugaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4985 - RNA, 1690 nt, Artificial Sequence
  mRNA product Design1 comprising derived and/or modified sequence from Lassa virus__AIT17756__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaucacguacaaggggguguacgagcuccagacccuggagcuggacauggccagccucaacaugaccaugccgcuguccugcaccaagaacaacagccaccacuacaucauggucggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggccgcggguccugggacugcaucaugacgagcuaccaguaccucaucauccagaacaccaccugggaggaccacugccaguucucccggcccagccccaucggcuaccuggggcugcucagccagcgcacccgggacaucuacaucucccgccggcugcugggcacguucaccuggacccucagcgacuccgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacaccgucaccgggcggacgagccugccccgcugcuggcugguguccaacggcagcuaccugaacgagacccacuucuccgacgacaucgagcagcaggcggacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacaucaucggcaagcccugccccaagccccaccggcugaaccacauggggaucugcuccugcggccuguacaagcacccgggggugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4986 - RNA, 1690 nt, Artificial Sequence
  mRNA product Design1 comprising derived and/or modified sequence from Lassa virus__AIT17758__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcugaacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugcgaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccgucacggggaagaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4987 - RNA, 1690 nt, Artificial Sequence
  mRNA product Design1 comprising derived and/or modified sequence from Lassa virus__AIT17762__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucagccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgguggacgccgccaaccacugcgggaccaucgccaacggcguccugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccagccccaucggcuaccuggggcugcucucccagcggacgcgcgacaucuacaucagccggcgccugcugggcaccuucaccuggacccucuccgacagcgagggcaacgaggcccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgugaacgcccugaucaacgaccagcucaucaugaagaaccaccuccgggacaucaugggcaucccguacugcaacuacagccgcuacugguaccugaaccacaccgucacggggaagaccucccugccccggugcuggcuggugagcaacggcuccuaccugaacgagacccacuucagcgacgacaucgagcagcaggcggacaacaugaucaccgagcuccugcagaaggaguacauggaccgccagggcaagacgccccuggggcucguggaccuguucgucuucuccaccagcuucuaccugaucuccaucuuccugcaccucgugaagaucccgacccaccggcacgugaucggcaagcccugccccaagccccaccgccugaaccacauggggaucugcagcugcggccuguacaagcacccggggguccccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4988 - RNA, 1690 nt, Artificial Sequence
  mRNA product Design1 comprising derived and/or modified sequence from Lassa virus__AIT17770__GPC (opt1)
gggagaaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccaggcccuggagcuggacaugagcucccucaacaugaccaugccgcugagcugcaccaagaacaacucccaccacuacaucauggugggcaacgagacgggccuggagcucacccugaccaacaccagcaucauccaccacaaguucugcaaccuguccgacgcccacaagaaggaccucuacgaccacgcccugaugagcaucaucuccacguuccaccugagcauccccaacuucaaccaguacgaggccauguccugcgacuucaacgggggcaagaucagcgugcaguacaaccucucccacaccuacgcggucgacgccgccaaccacugcgggaccaucgccaacggcgugcugcagaccuucaugcggauggcguggggcgggagcuacaucgcccuggacuccggcaagggcgggugggacugcaucaugacgagcuaccaguuccucaucauccagaacaccaccugggaggaccacugccaguucucccgccccagccccaucggguaccugggccugcucagccagcggacccgcgacaucuacaucucccggcgccugcugggcacguucaccuggacccucagcgacuccgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggcgaucaagcggcucaagaccgaggcccagaugagcauccaccugaucaacaaggccgucaacgcccugaucaacgaccagcucaucaugaagaaccaccuccgcgacaucauggggauccccuacugcaacuacuccaaguacugguaccugaaccacaccgugacgggcaagaccagccugccccggugcuggcugguguccaacggcagcuaccugaacgagacccacuucuccgacgacaucgagcagcaggccgacaacaugaucaccgagcuccugcagaaggaguacaucgaccgccaggggaagacgccccugggccucgucgaccuguucguguucagcaccuccuucuaccugaucagcaucuuccugcaccucgugaagaucccgacccaccggcacgucaucgggaagcccugccccaagccccaccgccugaaccacaugggcaucugcuccugcgggcuguacaagcacccgggcgugcccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4989 - RNA, 1690 nt, Artificial Sequence
  mRNA product Design1 comprising derived and/or modified sequence from Lassa virus__AIT17778__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgcgggacgccgccaaccacugcgggaccaucgccaacggcgugcugcagacguucaugcgcauggcguggggcgggagcuacaucgcccuggacuccggcaaggggagcugggacugcaucaugaccuccuaccaguaccucaucauccagaacaccaccugggaggaccacugccaguucagccggcccucccccaucggcuaccuggggcugcucagccagcgcacgcgggacaucuacaucagccgccggcugcugggcaccuucaccuggacccucuccgacagcgagggcaacgagacgcccgggggcuacugccugacccgcuggaugcugaucgaggccgagcucaagugcuucgggaacaccgccgucgccaagugcaacgagaagcacgacgaggaguucugcgacaugcugcggcuguucgacuucaacaagcaggcgauccgccggcucaagaccgaggcccagaugaacauccagcugaucaacaaggccgugaacgcccugaucaacgaccagcucaucaugaagaaccaccuccgcgacaucaugggcauccccuacugcaacuacuccaaguacugguaccugaaccacacggugaccgggaagaccagccugccccggugcuggcuggucuccaacggcagcuaccugaacgagacccacuucuccgacgacaucgagcagcaggccgacaacaugaucacggagcuccugcagaaggaguacauggaccgccagggcaagaccccgcuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4990 - RNA, 1690 nt, Artificial Sequence
  mRNA product Design1 comprising derived and/or modified sequence from Lassa virus__AIT17782__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaagcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacguggucggcaagcccugccccaagccccaccgccugaaccacauggggaucugcuccugcggccuguacaagcacccgggggugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4991 - RNA, 1690 nt, Artificial Sequence
  mRNA product Design1 comprising derived and/or modified sequence from Lassa virus__AIT17786__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccaucgacgccgccgaccacugcgggaccaucgcgaacggcgugcugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgugacggggaagaccagccugccccgcugcuggcuggucuccaacggcagcuaccugaacgagacccacuucuccgacgacaucgagcagcaggcggacaacaugaucaccgagcuccugcagaaggaguacauggaccggcagggcaagacgccccuggggcucguggaccuguucguguucagcaccuccuucuaccugaucagcaucuuccugcaccucgucaagaucccgacccaccgccacaucaccggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4992 - RNA, 1690 nt, Artificial Sequence
  mRNA product Design1 comprising derived and/or modified sequence from Lassa virus__AIT17790__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucgugaagaucccgacccaccgccacaucacgggcaagcccugccccaagccccaccggcugaaccacauggggaucugcuccugcggccuguacaagcacccgggggugcccgucaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4993 - RNA, 1690 nt, Artificial Sequence
  mRNA product Design1 comprising derived and/or modified sequence from Lassa virus__AIT17798__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaugcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagaugcuccagaaggaguaccuggaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4994 - RNA, 1693 nt, Artificial Sequence
  mRNA product Design1 comprising derived and/or modified sequence from Lassa virus__AIT17802__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacaaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcgaccggugggacugcaucaugaccagcuaccaguaccugaucauccagaacaccacgugggaggaccacugccaguucucccgccccagccccaucggcuaccucgggcugcugucccagcggacccgcgacaucuacaucagccggcgccuccugggcaccuucaccuggacgcugagcgacuccgagggcaaggacacccccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcauccccuacugcaacuacuccaaguacugguaccugaaccacacgaccaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcucggcaagaccccgcuggggcuggucgaccuguucguguucagcaccuccuucuaccucaucagcaucuuccugcaccuggugaagaucccgacgcaccgccacaucgucggccgguccugccccaagccccaccgccucaaccacauggggaucugcagcugcggccuguacaagcagcccggggugccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4995 - RNA, 1693 nt, Artificial Sequence
  mRNA product Design1 comprising derived and/or modified sequence from Lassa virus__AIT17806__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggcaagugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4996 - RNA, 1693 nt, Artificial Sequence
  mRNA product Design1 comprising derived and/or modified sequence from Lassa virus__AIT17810__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaaggacaacagccaccacuacauccgggugggcaacgagaccggccuggagcugacgcucaccaacaccuccauccugaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggccgcaucuccguccaguacaaccucagccacuccuacgccggggacgcggccaaccacugcggcacgguggccaacggggugcugcagaccuucaugcggauggccuggggcggcagcuacaucgcgcuggacuccgggcgcggccggugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugccccggugcuggcugguguccaacggcagcuaccugaacgagacgcacuucuccgacgacaucgagcagcaggccgacaacaugaucaccgagaugcuccagaaggaguacauggagcgccaggggaagacgccccugggccuggucgaccuguucguguucagcaccuccuucuaccucaucagcaucuuccugcaccuggugaagaucccgacccaccggcacgucguggggaagcccugccccaagccccaccgccucaaccacaugggcaucugcuccugcgggcuguacaagcagccgggcgugcccgucaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4997 - RNA, 1693 nt, Artificial Sequence
  mRNA product Design1 comprising derived and/or modified sequence from Lassa virus__AIT17814__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucgaccacaaguucugcaaccucagcgacgcccaccggaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccaaggacgcggccgaccacugcgggacgguggccaacggcgugcugcagaccuucaugcgcauggccuggggcgggagcuacaucgcgcucgacuccggccgggggcgcugggacugcaucaugaccagcuaccaguaccugaucauccagaacaccacgugggaggaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcgccagggcaagaccccgcuggggcucgucgaccuguucguguucagcaccuccuucuaccugaucagcaucuuccugcaccucgugaagaucccgacgcaccggcacaucgucggcaagcccugccccaagccccaccgccugaaccacauggggaucugcuccugcggccuguacaagcagccgggggugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4998 - RNA, 1693 nt, Artificial Sequence
  mRNA product Design1 comprising derived and/or modified sequence from Lassa virus__AIT17820__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccgaggacgcggccaaccacugcgggacgguggccaacggcgugcugcagaccuucaugcggauggccuggggcgggagcuacaucgcgcucgacuccggccgcgggaacugggacugcaucaugaccagcuaccaguaccugaucauccagaacaccacgugggaggaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcgccagggcaagaccccgcuggggcucgucgaccuguucguguucagcaccuccuucuaccugaucagcaucuuccugcaccucgugaagaucccgacgcaccggcacaucgucggcaaguccugccccaagccccaccgccugaaccacauggggaucugcagcugcggccuguacaagcagcccggggugccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4999 - RNA, 1693 nt, Artificial Sequence
  mRNA product Design1 comprising derived and/or modified sequence from Lassa virus__AIT17824__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagcguguacaaggggguguacgagcuccagacccuggagcugaacauggagacgcucaacaugaccaugccgcuguccugcaccaagaacaacagccaccacuacaucauggucggcaacgagaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacuccuacgccggggacgcggccaaccacugcggcacgguggccaacgggguccugcagaccuucaugcggauggccuggggcggcagcuacaucgcgcuggacuccgggcacggcaagugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugcccaagugcuggcuggucuccaacggcagcuaccugaacgagacgcacuucuccgacgacaucgagcagcaggccgacaacaugaucaccgagaugcuccagaaggaguacauggagcggcaggggaagacgccccugggccugguggaccucuucguguucagcaccuccuucuaccugaucagcaucuuccugcaccuggucaagaucccgacccaccgccacaucguggggaaguccugccccaagccccaccggcucaaccacaugggcaucugcagcugcgggcuguacaagcagcccggcgugccgguccgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5000 - RNA, 1693 nt, Artificial Sequence
  mRNA product Design1 comprising derived and/or modified sequence from Lassa virus__AIT17828__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaagggggacuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5001 - RNA, 1690 nt, Artificial Sequence
  mRNA product Design1 comprising derived and/or modified sequence from Lassa virus__AIT17836__GPC (opt1)
gggagaaagcuuaccaugggccagaucaucaccuucuuccaggaggugccccacgucaucgaggaggugaugaacaucgugcugaucgcccucagccugcuggccauccucaaggggcuguacaacaucgcgaccugcggcaucaucgggcuggucgccuuccucuuccugugcggcaaguccugcagccugacgcucaagggcggguacgagcugcagacccuggagcucaacauggagacccugaacaugaccaugccgcuguccugcacgaagaacagcucccaccacuacauccgcgugggcaacgagaccgggcucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacggcgggaagaucagcgugcaguacaaccugucccacagcuacgcgggcgacgccgccgagcacugcgggaccgucgccaacggcgugcugcagaccuucaugcggauggcguggggcgggcgcuacaucgcccucgacuccggcaaggggaacugggacugcaucaugacgagcuaccaguaccugaucauccagaacaccaccugggaggaccacugccaguucucccggcccagccccaucggcuaccugggccuccugucccagcgcacccgggacaucuacaucagccgccggcugcucgggacguucaccuggacccugagcgacuccgagggcaacgagacccccgggggcuacugccugacgcgcuggaugcucaucgaggccgagcugaagugcuucgggaacaccgccguggccaagugcaacgagaagcacgacgaggaguucugcgacaugcugcggcuguucgacuucaacaagcaggcgauccgccggcugaaggccgaggcccagaugagcauccagcugaucaacaaggccgucaacgcccucaucaacgaccagcugaucaugaagaaccaccuccgcgacaucaugggcauccccuacugcaacuacuccaaguacugguaccucaaccacaccagcuccggccggaccagccugcccaagugcuggcugaucuccaacgggagcuaccucaacgagacgcaguucuccgacgacaucgagcagcaggcggacaacaugaucaccgagaugcugcagaaggaguacaucgagcgccagggcaagaccccgcuggggcucguggacaucuucaucuucagcaccuccuucuaccugaucagcaucuuccugcaccugaucaagaucccgacgcaccggcacaucgugggcaagcccugccccaagccccaccgccucaaccacaugggggucugcuccugcggccuguacaagcacccgggcgugcccaccaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5002 - RNA, 1693 nt, Artificial Sequence
  mRNA product Design1 comprising derived and/or modified sequence from Lassa virus__AIT17840__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaucagccucuacaaggggguguacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcgaccggugggacugcaucaugaccagcuaccaguaccugaucauccagaacaccaccugggaggaccacugccaguucucccgccccagccccaucggcuaccuggggcuccugucccagcggacgcgcgacaucuacaucagccggcgccugcucggcaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacaccacgaccgggaagaccagccugcccaagugcuggcugguguccaacggcagcuaccucaacgagacccacuucuccgacgacaucgagcagcaggccgacaacaugaucacggagaugcugcagaaggaguacauggagcggcagggcaagaccccgcuggggcucgucgaccuguucguguucagcaccuccuucuaccugaucagcaucuuccugcaccucgugaagaucccgacccaccgccacaucgucggcaagcccugccccaagccccaccggcugaaccacauggggaucugcuccugcggccuguacaagcagccgggggugcccgugaaguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5003 - RNA, 1693 nt, Artificial Sequence
  mRNA product Design1 comprising derived and/or modified sequence from Lassa virus__AIT17844__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaucagccucuacaaggggguguacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcgaccggugggacugcaucaugaccagcuaccaguaccugaucauccagaacaccaccugggaggaccacugccaguucucccgccccagccccaucggcuaccuggggcuccugucccagcggacgcgcgacaucuacaucagccggcgccugcucggcaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaaccgcgccgugaacgcccucaucaacgaccagcugaucaugaagaaccaccuccgggacaucaugggcauccccuacugcaacuacuccaaguacugguaccugaaccacaccacgaccgggaagaccagccugcccaagugcuggcugguguccaacggcagcuaccucaacgagacccacuucuccgacgacaucgagcagcaggccgacaacaugaucacggagaugcugcagaaggaguacauggagcgccagggcaagaccccgcuggggcucgucgaccuguucguguucagcaccuccuucuaccugaucagcaucuuccugcaccucgugaagaucccgacccaccggcacaucgucggcaagcccugccccaagccccaccgccugaaccacauggggaucugcuccugcggccuguacaagcagccgggggugcccgugaaguggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5004 - RNA, 1690 nt, Artificial Sequence
  mRNA product Design1 comprising derived and/or modified sequence from Lassa virus__AMR44577__GPC (opt1)
gggagaaagcuuaccaugggccagaucaucaccuucuuccaggaggugccccacgucaucgaggaggugaugaacaucgugcugaucgcccucagccugcuggccauccucaagggggucuacaacguggcgaccugcggcaucaucgggcuggugacguuccuguuccucugcggccgcuccugcagccugaucuacaagggguccuacgagcugcagacccucgagcugaacauggagacccugaacaugaccaugccgcucagcugcacgaagaacuccagccaccacuacauccgggucggcaacgagaccggccuggagcugacccucaccaacacguccaucaucaaccacaaguucugcaaccugagcgacgcccacaagcgcaaccuguacgaccacgcccucauguccauccugagcaccuuccaccuguccauccccaacuucaaccaguacgaggccaugagcugcgacuucaacgggggcaagaucuccgugcaguacaaccucagccacgccuacgcgguggacgccgccgagcacugcgggaccgucgccaacggcgugcugcagaccuucaugcggauggcguggggcggguccuacaucgcccuggacagcggccgcgggaacugggacugcaucaugacguccuaccaguaccucaucauccagaacaccaccugggaggaccacugccaguucagccggcccucccccaucggcuaccuggggcugcucagccagcgcacccgggacaucuacaucagccgccggcugcugggcacguucaccuggacccucuccgacagcgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccagcgccucaaguccgaggcccagaugagcauccagcugaucaacaaggccgucaacgcccugaucaacgaccagcucaucaugaagaaccaccuccgggacaugaugggcauccccuacugcaacuacuccaaguacugguaccugaaccacaccagcuccgggcgcaccagccugcccaagugcuggcugguguccaacggcagcuaccugaacgagacgcacuucuccgacgacaucgagcagcaggccgacaacaugaucaccgagaugcuccagaaggaguacaucgaccggcagggcaagaccccgcuggggcugguggaccucuucgucuucagcaccuccuucuaccugaucagcaucuuccugcaccugaucaagaucccgacgcaccgccacaucgugggcaagcccugccccaagccccaccggcucaaccacauggggaucugcuccugcggccuguacaagcagccgggggugcccacccgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5005 - RNA, 1693 nt, Artificial Sequence
  mRNA product Design1 comprising derived and/or modified sequence from Lassa virus__ANH09722__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagccucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgacgggaagaucagcguccaguacaaccugucccacacguacgcgggcgacaccgccaaccacugcgggaccguggccaacggcgugcuccagaccuucaugcgcauggccuggggcgggagcuacaucgcgcuggacuccggccgcgggggcugggacugcaucaugacgagcuaccaguaccugaucauccagaacaccaccugggaggaccacugccaguucucccggcccagccccaucggguaccucggccugcugucccagcggacccgcgacaucuacaucagccggcgccuccugggcacguucaccuggacccuguccgacagcgaggggaaggacaccccgggcggguacugccucacgcgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucauggggauccccuacugcaacuacuccaaguacugguaccugaaccacaccgugaccggcaagacgagccugcccaagugcuggcucgucuccaacggcagcuaccugaacgagacccacuucuccgacgacaucgagcagcaggccgacaacaugaucaccgagaugcugcagaaggaguacauggagcggcaggggaagacgccccucggccugguggaccuguucguguucagcaccuccuucuaccugaucagcaucuuccuccaccuggucaagaucccgacccaccgccacgugguggggaagcccugccccaagccccaccggcugaaccacaugggcaucugcuccugcggguucuacaagcagccgggcguccccgugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5006 - RNA, 1693 nt, Artificial Sequence
  mRNA product Design1 comprising derived and/or modified sequence from Lassa virus__ANH09724__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacgacucccaccacuacaucauggugggcaacgagaccggccucgagcugacgcugaccaacaccagcaucaucucccacaaguucugcaaccucagcgacgcccacaagcagaaccuguacgaccacgcccugauguccaucaucagcaccuuccaccucuccauccccaacuucaaccaguacgaggccaugagcugcgacuucaacgggggcaagaucuccguccaguacaaccugagccacacguacgcgggggacgccgccaaccacugcggcaccguggccaacggggugcugcagaccuucaugcggauggcguggggcggcuccuacaucgcccucgacagcgggcgcggcgggugggacugcaucaugaccuccuaccaguaccugaucauccagaacacgaccugggaggaccacugccaguucagccggcccucccccaucggcuaccugggccuccugagccagcgcacccgggacaucuacaucucccgccggcugcucgggaccuucacguggacccugagcgacagcgagggcaaggacacccccgggggcuacugccugacccgcuggaugcucaucgaggccgagcugaagugcuucgggaacacggccgucgccaagugcaacgagaagcacgacgaggaguucugcgacaugcugcggcuguucgacuucaacaagcaggcgauccagcgccugaaggccgaggcccagauguccauccagcugaucaacaaggccgugaacgcccucaucaacgaccagcugaucaugaagaaccaccuccgggacaucaugggcauccccuacugcaacuacagcaaguacugguaccucaaccacaccgugaccggcaagaccucccugcccaagugcuggcuggucagcaacggguccuaccucaacgagacgcacuucagcgacgacaucgagcagcaggcggacaacaugaucaccgagaugcugcagaaggaguacauggagcgccagggcaagaccccgcuggggcucguggaccuguucguguucuccaccagcuucuaccugaucuccaucuuccugcaccucgucaagaucccgacgcaccggcacguggugggcaagcccugccccaagccccaccgccugaaccacauggggaucugcagcugcggcuucuacggccagccggggguccccgugcgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5007 - RNA, 1693 nt, Artificial Sequence
  mRNA product Design1 comprising derived and/or modified sequence from Lassa virus__ANH09728__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacgucgcgaccugcggccugaucgggcuggugacguuccuccugcugugcggccgcuccugcaccaccacccucuacaaggggguguacgagcugcaggcccuggagcucaacaugggcacgcugaacaugaccaugccgcugagcugcaccaagaacaacucccaccacuacaucauggucggcaacgagaccgggcucgagcugacgcugaccaacaccagcaucaucaaccacaaguucugcaaccucuccgacgcccacaagaaggaccuguacgaccacgcccugaugagcaucaucuccaccuuccaccucagcgugcccaacuucaaccaguacgaggccauguccugcgacuucaacggcgggaagaucagcgugcaguacaaccugucccacgcguacgccggcgacacggccaaccacugcgggaccgucgccaacggcgugcugcagaccuucaugcggauggcguggggcgggagcuacaucgcccucgacuccggccgcgggggcugggacugcaucaugaccagcuaccaguaccugaucauccagaacacgaccugggaggaccacugccaguucucccggcccagccccaucggcuaccuggggcuccugucccagcgcacccgggacaucuacaucagccgccggcugcucggcaccuucacguggacccuguccgacagcgagggggaguacaccccgggcggguacugccugacccgcuggaugcucaucgaggccgagcugaagugcuucggcaacacggccguggccaagugcaacgagaagcacgacgaggaguucugcgacaugcugcggcuguucgacuucaacaagcaggcgauccagcgccugaaggccgaggcccagaugagcauccagcugaucaacaaggccgucaacgcccucaucaacgaccagcugaucaugaagaaccaccuccgggacaucaugggcauccccuacugcaacuacuccaaguacugguaccucaaccacaccgugaccgggaagaccagccugcccaagugcuggcugguguccaacggcagcuaccucaacgagacgcacuucuccgacgacaucgagcagcaggcggacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacgucguggggaagcccugccccaagccccaccgccugaaccacaugggcaucugcuccugcggcuucuacaagcagccgggggugcccguccgguggaagcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5008 - RNA, 1693 nt, Artificial Sequence
  mRNA product Design1 comprising derived and/or modified sequence from Lassa virus__ANH09730__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacgucgcgaccugcggccugaucgggcuggugacguuccuccugcugugcggccgcuccugcaccaccacccucuacaaggggguguacgagcugcaggcccuggagcucaacauggagacgcugaacaugaccaugccgcugagcugcaccaagaacaacucccaccacuacaucauggucggcaacgagaccggccucgagcugacgcugaccaacaccagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaaccaggggaagaucagcgugcaguacaaccugucccacgcguacgccggcgacgccgccaaccacugcgggacgguggcgaacggcguccugcagaccuucaugcggauggccuggggcgggagcuacaucgcccucgacuccggccgcgggggcugggacugcaucaugaccagcuaccaguaccugaucauccagaacaccacgugggagaaccacugccaguucucccggcccagccccaucggguaccugggccuccugucccagcgcacccgggacaucuacaucagccgccggcugcucggcaccuucaccuggacgcuguccgacagcgaggggaagggcacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgcuucaaggccgaggcccagaugagcauccagcugaucaacaaggccgugaacgcgcugaucaacgaccagcucaucaugaagaaccaccuccgggacaucaugggcauccccuacugcaacuacuccaaguacugguaccugaaccacacggucaccggcaagaccagccuccccaagugcuggcugguguccaacgggagcuaccugaacgagacccacuucuccgacgacaucgagcagcaggccgacaacaugaucacggagaugcuccagaaggaguacauggagcgccagggccggaccccgcuggggcugguggaccucuucgucuucagcaccuccuucuaccugaucagcaucuuccugcaccuggugaagaucccgacccaccgccacguggucggcaagcccugccccaagccccaccggcucaaccacauggggaucugcuccugcggcuucuacaagcagccgggcgugcccgugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5009 - RNA, 1693 nt, Artificial Sequence
  mRNA product Design1 comprising derived and/or modified sequence from Lassa virus__ANH09732__GPC (opt1)
gggagaaagcuuaccaugggccagaucgugaccuucuuccaggaggucccccacgugaucgaggaggugaugaacaucguccugaucgcccucagcauccuggccgugcugaaggggguguacaacgucgcgaccugcggccucaucgggcuggugacguuccugcuccuguccggccgcagcugcaccaccaccaucuacaaggggguguacgagcugcaggcccucgagcugaacauggagacgcugaacaugaccaugccgcucuccugcaccaagaacaacagccaccacuacaucauggucggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacacguacgcgggggacgccgccaaccacugcggcaccguggccaacgggguccuccagaccuucaugcggauggcguggggcggcuccuacaucgcccuggacagcgggcacggcgggugggacugcaucaugaccuccuaccaguaccugaucauccagaacacgaccugggagaaccacugccaguucagccgccccucccccaucggcuaccucggccugcugagccagcggacccgcgacaucuacaucucccggcgccuccuggggaccuucacguggacccugagcgacagcgagggcaaggacacccccgggggcuacugccucacccgguggaugcugaucgaggccgagcugaagugcuucgggaacacggccguggccaagugcaacgagaagcacgacgaggaguucugcgacaugcuccgccuguucgacuucaacaagcaggcgauccagcggcugaaggccgaggcccagauguccauccagcucaucaacaaggccgugaacgcccugaucaacgaccagcugaucaugaagaaccaccuccgcgacaucaugggcauccccuacugcaacuacagcaaguacugguaccugaaccacaccgucaccggcaagaccucccugcccaagugcuggcucgugagcaacggguccuaccugaacgagacgcacuucagcgacgacaucgagcagcaggcggacaacaugaucaccgagaugcugcagaaggaguacauggagcggcagggcaagaccccgcucgggcugguggaccuguucgucuucuccaccagcuucuaccucaucuccaucuuccugcaccuggugaagaucccgacgcaccgccacaucgugggcaagcccugccccaagccccaccggcugaaccacauggggaucugcagcugcggcuucuacaagcagccgggcguccccgugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5010 - RNA, 1690 nt, Artificial Sequence
  mRNA product Design1 comprising derived and/or modified sequence from Lassa virus__ANH09738__GPC (opt1)
gggagaaagcuuaccaugggccagaucgugaccuucuuccaggaggucccccacgugaucgaggagaucaugaacaucgugcugaucacccucagccugcuggccauccucaaggggcuguacaacuucgccacgugcggccugaucgggcucaucaccuuccuguuccugugcggccgcuccugcagcaugaucuacaagggguccuaccagcucgagacccuggagcugaacauggagacccucaacaugacgaugccgcugagcugcaccaagaacaacucccaccacuacauccgggucggcaacgagaccggccuggagcucacccugacgaacaccagcaucaucaaccacaaguucugcaaccuguccgacgcgcacaagcgcaaccucuacgaccacagccugauguccaucaucagcaccuuccaccuguccauccccaacuucaaccaguacgaggccaugagcugcgacuucaacgggggcaagaucuccauccaguacaaccucagccacaccuacgccggggacgccgccaagcacugcggcacgguggcgaacggggugcugcagaccuucaugcggauggccuggggcggcuccuacaucgcccuggacagcgggcgcggcaacugggacugcaucaugaccuccuaccaguaccucaucauccagaacaccacgugggaggaccacugccaguucagccggcccucccccaucggguaccugggccugcucagccagcgcacccgggacaucuacaucagccgccggcugcugggcaccuucaccuggacgcucuccgacagcgaggggaaggagaccccgggcggguacugccugacccgcuggaugcugaucgaggccgagcucaagugcuucggcaacaccgcggucgccaagugcaacgagaagcacgacgaggaguucugcgacaugcugcggcuguucgacuucaacaagcaggccauccagcgccucaagacggaggcccagauguccauccagcugaucaacaaggccgugaacgcgcugaucaacgaccagcucaucaugaagaaccaccuccgggacaucauggggauccccuacugcaacuacagcaaguacugguaccugaaccacaccuccaccggccgcaccagccugcccaagugcuggcugguguccaacggcagcuaccugaacgagacgcacuucuccgacgacaucgagcagcaggccgacaacaugaucaccgagaugcuccagaaggaguacaucgaccggcaggggaagacgccccugggccuggucgacguguucauguucagcaccuccuucuaccucaucagcaucuuccugcaccuggugaagaucccgacccaccgccacaucgucgggaaguccugccccaagccccaccggcugaaccacaugggcaucugcagcugcgggcucuacaagcagcccggcgugccggugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5011 - RNA, 1690 nt, Artificial Sequence
  mRNA product Design1 comprising derived and/or modified sequence from Lassa virus__ANH09740__GPC (opt1)
gggagaaagcuuaccaugggccagaucgugaccuucuuccaggaggucccccacgugaucgaggaggugaugaacaucguccugaucgcccucagccugcuggccauccucaaggggcuguacaacuucgcgaccugcggcgugaucgggcugaucacguuccuccugcugugcggccgcuccugcagcgccaccuacaaggggcaguacgagcuccagacccuggagcugaacauggagucccucaacaugaccaugccgcugagcugcacgaagaacaacucccaccacuacauccgggccggcaacaacaccggccuggagcucacccugaccaacacgagcaucaucucccacaaguucugcaaccugagcgacgcccacaagaagaaccucuacgaccacacccugauguccaucaucaccaccuuccaccugagcauccccaacuucaaccaguacgaggccauguccugcgacuucaacgggggcaagaucagcauccaguacaaccucucccacagcuacgcgggggacgccgcccagcacugcggcacgguggccaacgggguccugcagaccuucaugcgcauggcguggggcggcuccuaccuggcccucgacagcgggcggcgcggcugggacugcaucaucuccagcuaccaguaccugaucauccagaacaccaccugggacgaccacugccaguucucccggcccagccccaucggguaccugggcuucgugagccagaagacgcgcgacaucuacaucucccggcgccuccugggcaccuucaccuggacccugagcgacuccgaggggcacgacaugccgggcggguacugccucacgcgguggaugcugaucgaggccgaccugaagugcuucggcaacaccgccguggccaagugcaacgagaagcacgacgaggaguucugcgacauguggcgccucuucgacuucaacaagcaggcgauccagcggcugaaggccgaggcccagaugaacauccagcugaucaacaaggccgucaacgcccucaucaacgaccagcugaugaugaagaaccaccuccgcgacaucauggggauccccuacugcaacuacagcaaguucugguaccugaacaacaccaccacgggccggaccucccugccccgcugcuggcugaucagcaacggcuccuaccucaacgagacccacuucagcgacgacaucgagcagcaggcggacaacaugaucaccgagaugcugcagaaggaguacauggaccggcaggggaagacgccccugggccucguggaccuguucguguucuccaccagcuucuaccugaucaccaucuuccuccaccuggucaagaucccgacccaccgccacaucguggggaagcccugccccaagccccaccggcugaaccacaugggcaucugcuccugcgggcuguacaagcagccgggcgugcccguccgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5012 - RNA, 1690 nt, Artificial Sequence
  mRNA product Design1 comprising derived and/or modified sequence from Lassa virus__CAA36645__GPC (opt1)
gggagaaagcuuaccaugggccagaucgugaccuucuuccaggaggucccccacgugaucgaggaggugaugaacaucguccugaucgcccucagcauccuggccauccugaaggggcucuacaacguggcgaccugcggccugaucgggcuggugacguuccuccugcuguccggccgcagcugcucccucaucuacaaggggaccuacgagcugcagacccuggagcucaacauggagacccugaacaugacgaugccgcugagcugcaccaagaacaacucccaccacuacauccgggucggcaacgagaccggccucgagcugacccugacgaacaccagcauccucaaccacaaguucugcaaccuguccgacgcccacaagcgcaaccuguacgaccacagccucauguccaucaucagcaccuuccaccuguccauccccaacuucaaccaguacgaggccaugagcugcgacuucaacgggggcaagaucaccgugcaguacaaccugucccacagcuucgccguggacgccgcggggcacugcggcacgcucgccaacgggguccugcagaccuucaugcggauggccuggggcggcuccuacaucgcccuggacagcgggcgcggcaacugggacugcaucaugaccuccuaccaguaccucaucauccagaacaccacgugggacgaccacugccaguucagccggcccucccccaucggguaccugggccugcucagccagcgcacccgggacaucuacaucagccgccggcugcugggcaccuucaccuggacgcucuccgacagcgaggggaacgagaccccgggcggguacugccugacccgcuggaugcugaucgaggcggagcucaagugcuucggcaacaccgccguggccaagugcaacgagaagcacgacgaggaguucugcgacaugcugcggcuguucgacuucaacaagcaggccauccgccggcucaagacggaggcccagauguccauccagcugaucaacaaggcggugaacgcccugaucaacgaccagcucaucaugaagaaccaccuccgcgacaucauggggauccccuacugcaacuacagccgguacugguaccugaaccacaccuccaccggcaagaccagccugccccgcugcuggcugaucuccaacggcagcuaccugaacgagacgaaguucuccgacgacaucgagcagcaggccgacaacaugaucaccgagaugcuccagaaggaguacaucgaccggcaggggaagacgccccugggccuggucgaccuguucguguucagcaccuccuucuaccucaucagcaucuuccugcaccuggugaagaucccgacccaccgccacaucgucgggaagcccugccccaagccccaccggcucaaccacaugggcaucugcuccugcgggcuguacaagcagccgggcgugcccgugcgcuggaagcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5013 - RNA, 1693 nt, Artificial Sequence; identical to SEQ ID NO: 4833
  mRNA product Design1 comprising derived and/or modified sequence from Lassa virus__NP_694870__GPC (opt1) R6717

SEQ ID NO: 5014 - RNA, 1930 nt, Artificial Sequence
  mRNA product Design1 comprising derived and/or modified sequence from Lassa virus__AAA46284__NP (opt1)
gggagaaagcuuaccaugagcgccuccaaggaggugcgcagcugccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagaagcgggacgacggcgaccugaagcgccugcgggaccucaaccaggccgugaacaaccugguggagcugaaguccacccagcagaaguccguccuccgcguggggacgcugagcuccgacgaccugcucauccuggccgccgaccuggagaagcucaagagcaaggugacccggaccgagcgcccccuguccagcggcgucuacauggggaaccuguccagccagcagcucgaccagcggcgcgcccugcugaacaugaucggcaugaccggcguguccgggggcgggaagggcgcgagcaacgggaucgugcgggucugggacgugaagaacgccgagcuccugaacaaccaguucggcacgaugccgucccugacccucgccugccugaccaagcagggccagguggaccugaacgacgccguccaggcgcucaccgaccuggggcugaucuacacggccaaguaccccaacagcagcgaccucgaccgccugucccagagccaccccauccugaacaugaucgacaccaagaaguccagccucaacaucuccggcuacaacuucagccugggggccgccgugaaggccggcgcgugcaugcuggacggcgggaacaugcucgagaccaucaaggugagcccccagaccauggacggcauccucaagagcauccugaaggucaagaagucccuggggauguucgugagcgacacgccgggcgagcggaaccccuacgagaacauccuguacaagaucugccuguccggggacggcuggagcuacaucgccucccgcaccagcaucgugggccgggccugggagaacaccgucguggaccucgagcaggacaacaagccccagaagaucgggaacggcggguccaacaagagccugcaguccgccggcuucgccgcggggcugaucuacagccagcucaugacccugaaggacuucaagugcuucaaccugauccccaacgccaagacguggauggacaucgagggccgcccggaggaccccguggagaucgcccuguaccagcccuccagcggcugcuacguccacuucuuccgggagcccaccgaccucaagcaguucaagcaggacgccaaguacagccacgggcgcgacgugaccgaccuguucgccgcgcagccgggccugaccuccgccgucaucgaggcccucccccggaacauggugaucacgugccaggggagcgaggacauccgcaagcugcuggagucccagggccgccgggacaucaagcucaucgacaucacccugagcaaggccgacucccgcaaguucgagaacgccgugugggaccaguucaaggaccugugccacaugcacaccggggucgugguggagaagaagaagcggggcggcaaggaggagaucacgccccacugcgcgcucauggacugcaucauguucgacgccgccgucagcgggggccuggacgccaaggugcugcgcgugguccucccccgggacaugguguuccgcaccuccaccccgaaggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5015 - RNA, 1927 nt, Artificial Sequence
  mRNA product Design1 comprising derived and/or modified sequence from Lassa virus__AAF86704__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgaggugaacaacguccagcgccucaugcggaagcagaagcgcgacgacggcgaccugaagcggcugcgcgaccucaaccaggccgugaacaaccugguggagcugaaguccacccagcagaaguccauccuccgggucgggacgcugaccagcgacgaccugcucacccuggccgccgaccuggagaagcucaagagcaaggugauccgcaccgagcggccccuguccagcggcguguacauggggaaccuguccacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccugggccucaucuacaccgcgaaguaccccaacuccagcgaccuggaccgccugucccagagccacccgauccucaacaugguggacaccaagaaguccagccugaacaucagcggguacaacuucucccugggcgccgccgugaaggccggggccugcaugcucgacggcggcaacaugcuggagacgaucaaggucacgccccagaccauggacgggauccucaagagcauccugaaggugaagcggucccugggcauguucgugagcgacacccccggggagcgcaaccccuacgagaacauccuguacaagaucugccucuccggcgacggguggccguacaucgcgagccggaccuccaucgucggccgcgccugggagaacaccaccguggaccuggagagcgacggcaagccccagaagguggggaccgccggcuccaacaagagccugcaguccgccggguuccccacgggccucaccuacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccacggaccugaagcaguucaagcaggacgccaaguacagccacggcaucgacguggccgaccuguucccggcccagcccgggcucaccuccgccgucaucgaggcgcugccccggaacauggugcugaccugccagggcagcgacgacaucaagaagcuccuggacucccaggggcgccgcgacaucaagcugaucgacaucagccucagcaagguggacucccggaaguucgagaacgccgucugggaccagugcaaggaccugugccacaugcacaccggcgugguggucgagaagaagaagcgcgggggcaaggaggagaucacgccccacugcgcccugauggacugcaucauguucgacgccgccgugagcggcgggcucaacaucccggugcugcgggcgguccugccccgcgacaugguguuccggaccuccagccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5016 - RNA, 1927 nt, Artificial Sequence
  mRNA product Design1 comprising derived and/or modified sequence from Lassa virus__AAO59513__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaaggagcgccgggacgacagcgaccugaagcgccugcgggaccucaaccaggccgugaacaaccugguggagcugaaguccacccagcagaaguccguccuccgcgugggcacccugaccagcgacgaccugcucgugcuggccgccgaccuggagaagcuccggagcaaggucacccgcaccgagcggccccuguccgccgggguguacaugggcaaccugagcucccagcagcucgaccagcgccgggcgcugcugagcaugaucgggaugaacggcuccaaccagggcgcccgcgccgggcgggacggcgugguccgcgugugggacgugaagaacgccgagcuccugaacaaccaguucgggaccaugccgagccugacccucgcgugccugaccaagcagggccaggucgaccugaacgacgccgugcaggcccucaccgaccuggggcugaucuacacggccaaguaccccaacaccuccgaccucgaccggcugacccagagccaccccauccugaacaugaucgacaccaagaaguccagccucaacgugagcggcuacaacuucucccugggcgccgcggucaaggccggggccugcaugcuggacggcgggaacaugcucgagacgaucaaggugagcccccagaccauggacggcauccugaaguccauccugaaggugaagaaggcccucggcauguucaucagcgacaccccgggggagcgcaaccccuacgagaacauccuguacaagaucugccuguccggcgacggguggcccuacaucgccagccggaccuccaucacgggccgcgcgugggagaacaccgucguggaccucgagagcgacgagaagccccagaaggccggguccaacaacagcaacaagucccugcagagcgccggcuucaccgccggccugaccuacucccagcucaugacgcugaaggacgccaugcugcagcuggacccgaacgcgaagaccuggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacaucaccgaccuguucgccgcccagcccggccucacguccgcggucaucgacgcccugccccgcaacauggugaucacgugccaggggagcgacgacauccggaagcugcucgagagccagggccgcaaggacaucaagcugaucgacaucgcccugaacaaggccgacucccggaaguacgagaacgcggucugggaccaguacaaggaccucugccacaugcacaccggcgugguggucgagaagaagaagcgcgggggcaaggaggagaucacgccccacugcgcccugauggacugcaucauguucgacgccgccgugagcgggggccugaagacccucgugcugcgggccguccugccgcgcgacaugguguuccggaccuccacgccccgcgugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5017 - RNA, 1927 nt, Artificial Sequence
  mRNA product Design1 comprising derived and/or modified sequence from Lassa virus__AAT48999__NP (opt1)
gggagaaagcuuaccaugagcguguccaaggagaucaagagcuuccuguggacccagucccuccgccgggagcugagcggcuacugcuccaacaucaagcugcaggucgugaaggacgcccaggcccuccugcacgggcuggacuucagcgagguguccaacguccagcgccucaugcggaagcagcgccgggacgacaacgaccugaagcgccugcgggaccucaaccaggcggugaacaaccugguggagcucaagagcacccagcagaaguccguccugcgcgugggcacgcugaccagcgacgaccugcucauccuggccgccgaccuggagaagcucaaguccaaggugacccggaccgagcgcccccugagcgccggggucuacaugggcaaccuguccagccagcagcucgaccagcggcgcgcccugcugaacaugaucgggauguccggcggcaaccagggggcgcagacgggccgggacgggguggugcgcaucugggacgucaagaacgccgagcuccugaacaaccaguucggcaccaugccgagccugacccucgccugccugaccaagcagggccagguggaccugaacgacgugguccaggcccucacggaccuggggcugaucuacaccgcgaaguaccccaacaccuccgaccucgaccggcugacccagagccaccccauccugaacaugaucgacacgaagaaguccagccucaacaucagcggcuacaacuucucccugggggccgccgugaaggccggcgccugcaugcuggacgggggcaacaugcucgagaccaucaaggugagcccccagaccauggacggcauccugaaguccauccugaaggucaagaaggcgcucgggauguucaucagcgacaccccgggcgagcgcaaccccuacgagaacauccuguacaagaucugccuguccggggacggcuggcccuacaucgccagccggacguccaucaccgggcgcgccugggagaacaccgugguggaccucgagagcggcgagaagccccagaagaucggcuccaacaacagcaacaagugccugcaguccgccggguucaccgccggccugagcuacucccagcucaugacgcugaaggacgcgaugcugcagcuggacccgaacgccaagaccuggauggacaucgaggggcggcccgaggaccccgucgagaucgcccucuaccagcccagcuccggcugcuacauccacuucuuccgcgagccgaccgaccugaagcaguucaagcaggacgccaaguacagccacgggaucgacgugaccgaccuguucgccgcgcagcccggccucacguccgccgugaucgaggcccugccccggaacauggucaugaccugccagggcagcgacgacauccgcaagcugcucgagucccaggggcgcaaggacaucaagcugaucgacaucgcccugagcaagaccgacagccggaaguacgagaacgccgugugggaccaguacaaggaccucugccacaugcacaccggcgucgugguggagaagaagaagaagggcgggaaggaggagaucacgccccacugcgcgcugauggacugcaucauguucgacgccgccgucuccgggggccugaacaccagcgugcuccgcgccgugcugccgcgggacauggucuuccgcaccuccacccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5018 - RNA, 1927 nt, Artificial Sequence
  mRNA product Design1 comprising derived and/or modified sequence from Lassa virus__AAT49007__NP (opt1)
gggagaaagcuuaccaugagcguguccaaggagaucaagagcuuccuguggacccagucccuccgccgggagcugagcggcuacugcuccaacaucaagcugcaggucgugaaggacgcccaggcccuccugcacgggcuggacuucagcgagguguccaacguccagcgccucaugcggaagcagcgccgggacgacaacgaccugaagcgccugcgggaccucaaccaggcggugaacaaccugguggagcucaagagcacccagcagaaguccguccugcgcgugggcacgcugaccagcgacgaccugcucauccuggccgccgaccuggagaagcucaaguccaaggugacccggaccgagcgcccccugagcgccgggaucuacaugggcaaccuguccagccagcagcucgaccagcggcgcgcccugcugaacaugaucgggauguccggcggcaaccagggggcgcagacgggccgggacggggucgugcgcaucugggacgugaagaacgccgagcuccugaacaaccaguucggcaccaugccgagccugacccucgccugccugaccaagcaggggcaggucgaccugaacgacguggugcaggcccucacggaccugggccugaucuacaccgcgaaguaccccaacaccuccgaccucgaccggcugacccagagccaccccauccugaacaugaucgacacgaagaaguccagccucaacaucagcggcuacaacuucucccugggggccgccgucaaggccggcgccugcaugcuggacgggggcaacaugcucgagaccaucaaggugagcccccagaccauggacggcauccugaaguccauccugaaggugaagaaggcgcucgggauguucaucagcgacaccccgggcgagcgcaaccccuacgagaacauccuguacaagaucugccuguccggggacggcuggcccuacaucgccagccggacguccaucaccgggcgcgccugggagaacaccgucguggaccucgagagcggcgagaagccccagaagaucggcuccaacaacagcaacaagucccugcagagcgccggguucaccgccggccugacguacucccagcucaugacccugaaggacgcgaugcugcagcuggacccgaacgccaagaccuggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacgucacggaccuguucgccgcgcagcccggccucaccuccgccgugaucgaggcccugccccggaacauggugaugaccugccagggcagcgacgacauccgcaagcugcucgagucccaggggcgcaaggacaucaagcugaucgacaucgcccugagcaagaccgacagccggaaguacgagaacgccgucugggaccaguacaaggaccucugccacaugcacacgggcguggucguggagaagaagaagaagggcgggaaggaggagaucacgccccacugcgcgcugauggacugcaucauguucgacgccgccgccuccgggggccugaacacccucgugcugcgcgcgguccugccgcgggacaugguguuccgcaccagcacccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5019 - RNA, 1927 nt, Artificial Sequence
  mRNA product Design1 comprising derived and/or modified sequence from Lassa virus__AAT49009__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaaguccguccugcgcguggggacccugaacagcgacgaccugcucgugcuggccgccgaccuggagaagcucaaguccaaggucauccggaccgagcgcccccugagcuccggcaucuacauggggaaccugagcucccagcagcucgaccagcggcgcgcccugcugaacaugaucggcaugaccggcgggaaccggggcgggggcaccagcuccgacgggaucgugcgcgugugggacgucaagaacgcggagcuccugaacaaccaguucggcacgaugccgagccugacccucgccugccugaccaagcagggccagguggaccugaacgacgccgugcaggcccucaccgaccuggggcugaucuacacggcgaaguaccccaacuccagcgaccucgaccggcuggcccagagccaccccauccugaacaugaucgacaccaagaaguccagccucaacaucuccggcuacaacuucagccugggggccgccgucaaggccggcgcgugcaugcuggacggcgggaacaugcucgagaccaucaaggugagcccccagaccaucgacggcauccugaagacgauccugaaggugaagaagucccucgggauguucaucagcgacgucccgggcgagcgcaaccccuacgagaacauccuguacaagaucugccugagcggggacggcuggcccuacaucgccucccggaccagcaucgugggccgcgccugggagaacaccguggucgaccucgaguccgacaacaagccccagaagaccgggaacggcgggagcaacaagucccugcagagcgccggcuucgccgcggggcugacguacucccagcucaugacccugaaggacagcaugcugcagcuggacccgaacuccaagaccuggauggacaucgagggccggcccgaggaccccguggagaucgcccucuaccagcccaacagcggcugcuacauccacuucuuccgcgagccgaccgaccugaagcaguucaagcaggacgccaaguacucccacgggaucgacgugacggaccuguucgccgcccagcccggccucaccagcgcggucaucgaggcccugccccggaacauggugaucacgugccaggggagcgaggacauccgcaagcugcucgagucccagggccgccgggacaucaagcugaucgacaucagccugaacaaggccgacucccgcaaguucgagaacgccgucugggaccaguucaaggaccucugccacaugcacaccggggugguggucgagaagaagaagcggggcggcaaggaggagaucacgccccacugcgcccugauggacugcaucauguucgacgcggccgugagcgggggccuggacgccaaggugcuccgcgccguccugccgcgggacaugguguuccgcaccuccacccccaaggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5020 - RNA, 1927 nt, Artificial Sequence
  mRNA product Design1 comprising derived and/or modified sequence from Lassa virus__ADI39452__NP (opt1)
gggagaaagcuuaccaugagcguguccaaggaggucaagagcuuccuguggacccagucccuccgccgggagcugagcggcuacugcuccaacaucaagcuccagguggugaaggacgcccaggcccugcugcacgggcuggacuucagcgaggucuccaacgugcagcgccucaugcggaagcagcgccgggacgacaacgaccugaagcgccugcgggaccucaaccaggcggugaacaaccuggucgagcucaagagcacccagcagaaguccgugcugcgcgugggcacccugaccagcgacgaccugcucauccuggccgccgaccuggagaagcucaagaccaaggucacccggacggagcgcccccuguccgccgggguguacaugggcaaccugagcucccagcagcucgagcagcggcgcgcccugcugaacaugaucgggaugaacggcggcaaccagggggugcaggcgggccgggacggggucgugcgcgugugggacgucaagaacgccgagcuccugaacaaccaguucggcaccaugccgagccugacccucgccugccugaccaagcagggccagguggaccugaacgacgccgugcaggcgcucacggaccuggggcugaucuacaccgccaaguaccccaacaccuccgaccucgaccggcuggcccagagccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccugaaguccauccugaaggugaagcgcacccucgggauguucgucagcgacaccccgggcgagcggaaccccuacgagaacauccuguacaagaucugccuguccggggacggcuggcccuacaucgccagccgcacguccaucaccgggcgggccugggagaacaccaucguggaccucgagagcgacggcaagccccagaaggugggcaacaacggguccaacaagagccugcaguccgccggcuucaccgcggggcugacguacagccagcucaugacccugaaggacgccaugcugcagcuggacccgaacgccaagaccuggauggacaucgagggccgccccgaggaccccgucgagguggcccucuaccagcccuccagcgggugcuacauccacuucuuccgggagccgaccgaccugaagcaguucaagcaggacgccaaguacucccacggcaucgacgucacggaccuguucgcggcccagcccggccucaccagcgccgugaucgaggcccugccccgcaacauggugaucacgugccagggguccgaggacguccgcaagcugcucgagagccagggccggaaggacaucaagcugaucgacaucgcccuguccaaggcggacagccgcaaguacgagaacgccgugugggaccaguacaaggaccucugccacaugcacaccgggguggucguggagaagaagaagcggggcgggaaggaggagaugacgccccacugcgcccugauggacugcaucauguucgacgccgcgguguccggcggccugagcacccagguccuccgcgccgugcugccgcgggacaugguguuccgcaccagcacccccaaggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5021 - RNA, 1927 nt, Artificial Sequence
  mRNA product Design1 comprising derived and/or modified sequence from Lassa virus__ADU56611__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugaccagcgacgaccugcucacccuggccgccgaccuggagaagcucaaguccaaggugauccgcaccgagcggccccugagcuccggcgucuacauggggaaccugagcacgcagcagcucgagcagcgcaaggcccugcuguccaugaucggcauggugggcggggcgcagggcacccagccggggcgggacggcgugguccgcgugugggacgugaagaaccccgaccuccugaacaaccaguucgggaccaugcccagccugacccucgccugccugacgaagcagggccaggucgaccugaacgacgccgugcucgcccugaccgaccugggccucaucuacaccgcgaaguaccccaacuccagcgaccuggaccggcugucccagagccacccgauccucaacaugguggacaccaagaaguccagccugaacaucagcggguacaacuucucccugggcgccgccgucaaggccggggccugcaugcucgacggcggcaacaugcuggagacgaucaaggugacgccccagaccauggacgggauccucaagagcauccugaaggugaagcgcucccugggcauguucgucagcgacacccccggggagcggaaccccuacgagaacauccuguacaagaucugccucuccggcgacggguggccguacaucgcgagccgcaccuccaucgugggccgggccugggagaacaccaccguggaccuggagagcgacggcaagccccagaaggucgggaccgccggcuccaacaagagccugcaguccgccggguuccccacgggccucaccuacagccagcugaugacccugaaggacuccaugaugcagcuggaccccagcgccaagaccuggaucgacaucgaggggcgcccggaggaccccguggagaucgcgcucuaccagcccauguccggcugcuacauccacuucuuccgggagcccacggaccugaagcaguucaagcaggacgccaaguacagccacggcaucgacgucaccgaccuguucuccgcccagccggggcucaccagcgccgugaucgaggcccugccccgcaacauggugcugaccugccagggcagcgacgacaucaagaagcuccuggacucccaggggcggcgcgacaucaagcugaucgacaucagccucaacaaggcggacucccgccgguucgagaacgccgucugggaccagugcaaggaccugugccacaugcacacgggcgugguggucgagaagaagaagcgcgggggcaaggaggagaucacgccccacugcgcccugauggacugcaucauguucgacgccgccgugagcggcgggcucaacauccccauccugcgggcggugcugccgcgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5022 - RNA, 1927 nt, Artificial Sequence
  mRNA product Design1 comprising derived and/or modified sequence from Lassa virus__ADU56615__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccggaucggcacccugagcagcgacgaccugcucauccuggccgccgaccuggagaagcucaaguccaagguggugcgcaccgagcggccccugagcuccgggaucuacaugggcaaccugagcucccagcagcucgaccagcgcaaggcccugcugaacaugaucgggaugaccggcggcaacgggggccggaacgcgaccagcgacgggaucguccgcgugugggacgugaagaacgccgagcuccugaacaaccaguucggcacgaugccgucccugacccucgccugccugaccaagcaggggcaggucgaccugaacgacgccgugcaggcgcucaccgaccugggccugaucuacacggccaaguaccccaacagcagcgaccucgaccggcuggcccagucccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagaccauggacggcauccugaaguccauccugaaggugaagcgcagccucgggauguucaucuccgacacgccgggcgagcggaaccccuacgagaacauccuguacaagaucugccugagcggggacggcuggcccuacaucgccucccgcaccagcaucguggggcgggccugggagaacaccgucguggaccucgagaccgacaacaagccccagaagacgggcaacggcggguccaacaagagccugcaguccgccggcuucgcggccgggcugaccuacagccagcucaugacccugaaggacuccaugcugcagcuggacccgaacgccaagaccuggauggacaucgagggccgccccgaggaccccguggagaucgcccucuaccagcccgucagcgggugcuacauccacuucuuccgggagccgacggaccugaagcaguucaagcaggacgccaaguacucccacggcaucgacgugaccgaccuguucgcggcccagcccggccucaccagcgccgugaucgaggcccugccccgcaacauggucaucacgugccaggggagcgaggacauccggaagcugcucgagucccagggccgccgcgacaucaagcugaucgacaucagccuguccaagguggacagccggaaguucgagaacgccgucugggaccaguucaaggaccucugccacaugcacaccgggaucgugguggagaagaagaagcgcggcgggaaggaggagaucacgccccacugcgcgcugauggacugcaucauguucgacgccgccgucuccggcggcguggacgccaaggugcugcgggcgguccucccgcgcgacaugguguuccggaccagcacccccaaggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5023 - RNA, 1927 nt, Artificial Sequence
  mRNA product Design1 comprising derived and/or modified sequence from Lassa virus__ADU56619__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugagcuccgacgaccugcucgugcuggccgccgaccuggagaagcucaagagcaaggucgugcgcaccgagcggccccuguccagcggcaucuacauggggaaccuguccagccagcagcucgaccagcgcaaggcccugcugaacaugaucggcaugaccggcgggaacggcgggcggaacaccacguccgacggcaucgugcgcgucugggacgugaagaacgcggagcuccugaacaaccaguucgggaccaugccgagccugacccucgccugccugaccaagcagggccagguggaccugaacgacgccguccaggcccucacggaccugggccugaucuacaccgcgaaguaccccaacuccagcgaccucgaccggcuggcccagagccaccccauccugaacaugaucgacaccaagaaguccagccucaacaucuccggguacaacuucagccugggcgccgccgugaaggccggggcgugcaugcuggacggcggcaacaugcucgagaccaucaaggugagcccccagacgauggacgggauccucaagagcauccugaaggucaagcgcucccugggcauguucaucagcgacaccccgggggagcggaaccccuacgagaacauccuguacaagaucugccuguccggcgacggguggcccuacaucgccagccgcaccuccaucgugggccgggccugggagaacaccguggucgaccucgagagcgacaacaagccccagaagacgggcaacgggggcuccaacaagagccugcaguccgccggguucgccgcgggccugaccuacagccagcucaugacccugaaggacuccaugcugcagcuggacccgaacgccaagaccuggauggacaucgaggggcgccccgaggaccccguggagaucgcccucuaccagcccagcuccggcugcuacauccacuucuuccgggagccgacggaccugaagcaguucaagcaggacgccaaguacagccacggcaucgacgugaccgaccuguucgccgcgcagcccgggcucaccagcgccgucaucgaggcccugccccgcaacauggugaucacgugccagggcuccgaggacauccggaagcugcucgagagccaggggcgccgcgacaucaagcugaucgacaucucccugagcaaggucgacucccggaaguucgagaacgccgugugggaccaguucaaggaccucugccacaugcacaccggcaucguggucgagaagaagaagcgcgggggcaaggaggagaucacgccccacugcgcccugauggacugcaucauguucgacgcggccgugagcggcgggguggacgccaagguccugcgggccgugcucccgcgcgacaugguguuccggaccuccacccccaaggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5024 - RNA, 1927 nt, Artificial Sequence
  mRNA product Design1 comprising derived and/or modified sequence from Lassa virus__ADU56623__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccgucgagaucgcgcuguaccagcccauguccgggugcuacauccacuucuuccgggagcccacggaccugaagcaguucaagcaggacgccaaguacagccacggcaucgacguggccgaccucuucccggcccagcccggccugaccuccgccgucaucgaggcgcugccccgcaacauggugcugaccugccaggggagcgacgacaucaagcggcuccuggacagccagggccgccgcgacaucaagcucaucgacaucgcccuguccaaggccgacagccggcgcuucgagaacgccgugugggaccagugcaaggaccugugccacaugcacaccggggucgugguggagaagaagaagcggggcgggaaggaggagaucacgccccacugcgcccucauggacugcaucauguacgacgcggccgucuccggcggccugaacaucccggugcugcgcgccgugcucccccgggacauggucuuccgcaccagcucccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5025 - RNA, 1927 nt, Artificial Sequence
  mRNA product Design1 comprising derived and/or modified sequence from Lassa virus__ADU56627__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccugaacacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagucccacccgauccucaacauggucgacaccaagaaguccagccugaacaucagcggcuacaacuucagccugggggccgccgugaaggccggcgcgugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggccugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgcgaagaccuggaucgacaucgagggccgcccggaggaccccguggagaucgcccucuaccagcccaugagcgggugcuacauccacuucuuccgggagcccacggaccugaagcaguucaagcaggacgccaaguacucccacggcaucgacgucgccgaccuguucccggcccagcccggccucaccagcgcggugaucgaggcccugccccgcaacaugguccugaccugccagggguccgacgacaucaagcggcuccuggacagccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5026 - RNA, 1927 nt, Artificial Sequence
  mRNA product Design1 comprising derived and/or modified sequence from Lassa virus__ADU56631__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacgugaccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5027 - RNA, 1927 nt, Artificial Sequence
  mRNA product Design1 comprising derived and/or modified sequence from Lassa virus__AFY05580__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccggcggcaagccccagaaggccgacagcaacaacuccagcaagucccugcagagcgccggguucaccgccggccugaccuacucccagcucaugacccugaaggacgccaugcugcagcuggacccgaacgcgaagacguggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacgugaccgaccuguucgccacccagcccggccucacguccgccgucaucgacgcgcugccccgcaacauggugaucacgugccagggcagcgacgacauccggaagcugcucgagagccaggggcgcaaggacaucaagcugaucgacaucgaccuguccaagaccgacagccggaaguacgagaacgccgugugggaccaguacaaggaccucugccacaugcacaccggcgucguggucgagaagaagaagcgcgggggcaaggaggagaucaccccgcacugcgcccugauggacugcaucauguucgacgccgcgguguccgggggccugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5028 - RNA, 1927 nt, Artificial Sequence
  mRNA product Design1 comprising derived and/or modified sequence from Lassa virus__AFY05581__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccggcggcaagccccagaaggccgacagcaacaacuccagcaagucccugcagagcgccggguucaccgccggccugaccuacucccagcucaugacccugaaggacgccaugcugcagcuggacccgaacgcgaagacguggauggacaucgaggggcgccccgaggaccccguggagaucgcccucuaccagcccagcuccggcugcuacauccacuucuuccgggagccgaccgaccugaagcaguucaagcaggacgccaaguacagccacgggaucgacgugaccgaccuguucgccacccagcccggccucacguccgccgucaucgacgcgcugccccgcaacauggugaucacgugccagggcagcgacgacauccgcaagcugcucgagagccaggggcggaaggacaucaagcugaucgacaucgaccuguccaagaccgacagccgcaaguacgagaacgccgugugggaccaguacaaggaccucugccacaugcacaccggcgucguggucgagaagaagaagcgcgggggcaaggaggagaucaccccgcacugcgcccugauggacugcaucauguucgacgccgcgguguccgggggccugaacaccagcgugcucaaggccguccugccccgggacaugguguuccggaccuccacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5029 - RNA, 1927 nt, Artificial Sequence
  mRNA product Design1 comprising derived and/or modified sequence from Lassa virus__AFY05587__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5030 - RNA, 1927 nt, Artificial Sequence
  mRNA product Design1 comprising derived and/or modified sequence from Lassa virus__AFY05591__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgucgagcuccugagcaaccaguucggcaccaugccgucccugacgcucgccugccugaccaagcagggccagguggaccugaacgacgcggugcaggcccucaccgaccuggggcugaucuacaccgccaaguaccccaacacgagcgaccucgaccgccuggcccagucccaccccauccugaacaugaucgacaccaagaaguccagccucaacaucuccggcuacaacuucagccugggggccgcggucaaggccggcgccugcaugcuggacgggggcaacaugcucgagaccaucaaggugagcccccagaccauggacggcauccucaagagcauccugaaggugaagaaggcccuggggauguucaucuccgacacgccgggcgagcggaaccccuacgagaacauccuguacaagaucugccugagcggggacggcuggcccuacaucgccucccgcaccagcaucaccgggcgggcgugggagaacaccgucguggaccucgaguccgacggcaagccccagaaggccgacagcaacaacuccagcaagucccugcagagcgccggcuucacggccgggcugaccuacucccagcucaugacccugaaggacgccaugcugcagcuggacccgaacgcgaagaccuggauggacaucgagggccgccccgaggaccccguggagaucgcccucuaccagcccagcuccgggugcuacauccacuucuuccgggagccgacggaccugaagcaguucaagcaggacgccaaguacagccacggcaucgacgucaccgaccuguucgccacccagcccgggcucaccuccgccgugaucgacgcgcugccccgcaacauggugaucacgugccagggcagcgacgacauccgcaagcugcucgagagccagggccggaaggacaucaagcugaucgacaucgaccuguccaagaccgacagccgcaaguacgagaacgccgucugggaccaguacaaggaccucugccacaugcacaccgggguggucguggagaagaagaagcggggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5031 - RNA, 1927 nt, Artificial Sequence
  mRNA product Design1 comprising derived and/or modified sequence from Lassa virus__AFY05597__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccgcaagcugcucgagagccagggccggaaggacaucaagcugaucgacaucgaccuguccaagaccgacagccgcaaguacgagaacgccgugugggaccaguacaaggaccucugccacaugcacaccggggucguggucgagaagaagaagcggggcgggaaggaggagaucaccccgcacugcgcccugauggacugcaucauguucgacgccgcgguguccggcgggcugaacaccagcgugcuccgcgccguccugccccgggacaugguguuccgcaccuccacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5032 - RNA, 1927 nt, Artificial Sequence
  mRNA product Design1 comprising derived and/or modified sequence from Lassa virus__AFY05610__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacgcugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacacgaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgugaccgaccuguucgccacgcagcccgggcucaccuccgccgucaucgacgcccugccccgcaacauggugaucacgugccagggcagcgacgacauccgcaagcugcucgagagccagggccggaaggacaucaagcugaucgacaucgaccuguccaagaccgacagccgcaaguacgagaacgcggugugggaccaguacaaggaccucugccacaugcacaccggggucguggucgagaagaagaagcggggcgggaaggaggagaucaccccgcacugcgcccugauggacugcaucauguucgacgccgccguguccggcgggcugaacaccagcgugcuccgcgcgguccugccccgggacaugguguuccgcaccuccacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5033 - RNA, 1927 nt, Artificial Sequence
  mRNA product Design1 comprising derived and/or modified sequence from Lassa virus__AFY05616__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccuggcccagucccaccccauccugaacaugaucgacaccaagaaguccagccucaacaucuccggcuacaacuucagccugggggcggccgugaaggccggcgccugcaugcuggacgggggcaacaugcucgagaccaucaaggucagcccccagaccauggacggcauccucaagagcauccugaaggugaagaaggcccuggggauguucaucuccgacacgccgggcgagcggaaccccuacgagaacauccuguacaagaucugccugagcggggacggcuggcccuacaucgcgucccgcaccagcaucaccgggcgggccugggagaacaccguggucgaccucgaguccgacggcaagccccagaaggccgacagcaacaacuccagcaagucccugcagagcgccggcuucacggccgggcugaccuacucccagcucaugacccugaaggacgcgaugcugcagcuggacccgaacgccaagaccuggauggacaucgagggccgccccgaggaccccguggagaucgcccucuaccagcccagcuccgggugcuacauccacuucuuccgggagccgacggaccugaagcaguucaagcaggacgccaaguacagccacggcaucgacgugaccgaccuguucgccacccagcccgggcucaccuccgcggucaucgacgcccugccccgcaacauggugaucacgugccagggcagcgacgacauccgcaagcugcucgagagccagggccggaaggacaucaagcugaucgacaucgaccuguccaagaccgacagccgcaaguacgagaacgccgugugggaccaguacaaggaccucugccacaugcacaccggggucguggucgagaagaagaagcggggcgggaaggaggagaucacgccccacugcgcccugauggacugcaucauguucgacgcggccguguccggcgggcugaacaccagcgugcuccgcgccguccugccgcgggacaugguguuccgcaccuccacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5034 - RNA, 1933 nt, Artificial Sequence
  mRNA product Design1 comprising derived and/or modified sequence from Lassa virus__AFY05618__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcagaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5035 - RNA, 1927 nt, Artificial Sequence
  mRNA product Design1 comprising derived and/or modified sequence from Lassa virus__AHC95552__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacccugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcaugacgggcgggaaccagggcacccaggcggggcgggacggcguggugcgcgucugggacgugaagaacgccgagcuccugaacaaccaguucgggaccaugccgucccugacccucgccugccugacgaagcagggccaggccgaccugaacgacgugguccaggcgcucaccgaccugggccugaucuacaccgccaaguaccccaacgccagcgaccucgaccggcugacccagucccaccccauccugaacaugaucgacacgaagaaguccagccucaacaucagcggguacaacuucagccugggcgccgccgugaaggcgggggccugcaugcuggacggcggcaacaugcucgagaccaucaaggugagcccccagagcauggacgggauccugaaguccauccugaaggucaagcgcgcccucggcauguucgugagcgacaccccgggggagcggaaccccuacgagaacauccuguacaagaucugccuguccggcgacggguggcccuacaucgccagccgcaccuccaucgugggccgggccugggagaacacggucguggaccucgaggcggacggcaaccccaagaagcugaacagcaacggguccaacaagagccugcaguccgccggcuucccggccgggcucaccuacagccagcugaugacccugaaggacgccaugcugcagcucgaccccaacgccaagaccuggauggacaucgagggccgccccgaggaccccguggaggucgcgcuguaccagccgaacuccgggugcuacauccacuucuuccgggagcccacggaccugaagcaguucaagcaggacgccaaguacagccacggcaucgacgugaccgaccucuucgccgcccagcccggccugaccuccgccgucaucgaggcgcugccccgcaacauggugaucacgugccaggggagcgaggacauccgcaagcuccuggagucccagggccggaaggacaucaagcugaucgacaucgcccucagcaagaccgacucccgcaaguucgagaacgccgugugggaccaguacaaggaccugugccacaugcacaccggggucgugguggagaagaagaagcggggcgggaaggaggagaucaccccgcacugcgcccugauggacugcaucauguucgacgcggccgucagcggcggccucaacacccuggugcugcgcgccgugcucccccgggacauggucuuccgcacgagcacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5036 - RNA, 1927 nt, Artificial Sequence
  mRNA product Design1 comprising derived and/or modified sequence from Lassa virus__AHC95554__NP (opt1)
gggagaaagcuuaccaugagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagcggcgcgacgacggcgaccugaagcggcugcgcgaccucaaccaggccgugaacaaccugguggagcucaagagcacccagcagaaguccguccugcggguggggacccugaacagcgacgaccugcucacccuggccgccgaccuggagaagcucaaguccaaggugacccgcaccgagcggccccugagcuccggcgucuacauggggaaccugagcucccagcagcucgaccagcgccgggcccugcugaacaugaucggcaugacgggcgggaaccagggcgcgcaggccgggcgcgacggcguggugcgggucugggacgugaagaacgccgagcuccugaacaaccaguucgggaccaugccgagccugacccucgccugccugaccaagcagggccagguggaccugaacgacgucgugcaggcgcucacggaccugggccugaucuacaccgccaaguaccccaacaccuccgaccucgaccgccugacccagagccaccccauccugaacaugaucgacacgaagaaguccagccucaacaucagcggguacaacuucucccugggcgccgccgugaaggccggggcgugcaugcuggacggcggcaacaugcucgagaccaucaagaucagcccccaguccgucgacgggauccucaagagcauccugaaggugaagcggucccugggcauguucgugagcgacaccccgggggagcgcaaccccuacgagaacauccuguacaagaucugccuguccggcgacggguggcccuacaucgccagccggaccuccaucgucggccgcgccugggagaacacggugguggaccucgaggccgacggcaagccccagaagccgaacagcggguccagcaacaagucccugcagagcgccggcuuccccgcggggcugaccuacucccagcucaugacccugaaggacgccaugcugcagcuggaccccaacgccaagaccuggauggacaucgagggccggcccgaggacccggucgagguggcccucuaccagcccagcuccgggugcuacauccacuucuuccgcgagcccacggaccugaagcaguucaagcaggacgccaaguacagccacggcaucgacgucaccgaccuguucgcggcccagcccggccucaccuccgccgugaucgaggcccugccgcgcaacauggugaucacgugccaggggagcgaggacaucaagaagcugcucgagagccagggccggaaggacaucaagcugaucgacaucgcccuguccaagaucgacagccgcaaguucgagaacgcggucugggaccaguacaaggaccucugccacaugcacaccggggugguggucgagaagaagaagcggggcgggaaggaggagaucacgccccacugcgcccugauggacugcaucauguucgacgccgccguguccggcggccugaacgcgagcgugcuccgcgccguccugccccgggacaugguguuccgcaccuccacccccaaggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5037 - RNA, 1927 nt, Artificial Sequence
  mRNA product Design1 comprising derived and/or modified sequence from Lassa virus__AHC95556__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacgcugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcaugacgggcgggaaccagggcacccagaccgggcgggacggcguggugcgcgucugggacgugaagaacgcggagcuccugaacaaccaguucgggaccaugccgucccugacgcucgccugccugaccaagcagggccaggccgaccugaacgacgugguccaggcccucaccgaccugggccugaucuacaccgcgaaguaccccaacgccagcgaccucgaccggcugacgcagucccaccccauccugaacaugaucgacaccaagaaguccagccucaacaucagcggguacaacuucagccugggcgccgccgugaaggccggggcgugcaugcuggacggcggcaacaugcucgagaccaucaaggugagcccccagagcauggacgggauccugaaguccauccugaaggucaagcgcgcccucggcauguucgugagcgacaccccgggggagcggaaccccuacgagaacauccuguacaagaucugccuguccggcgacggguggcccuacaucgccagccgcacguccaucgugggccgggccugggagaacaccgucguggaccucgaggccgacggcaaccccaagaagcugaacagcaacggguccaacaagagccugcaguccgcgggcuucccggccgggcucaccuacagccagcugaugacccugaaggacgccaugcugcagcucgaccccaacgccaagacguggauggacaucgagggccgccccgaggaccccguggaggucgcccuguaccagccgaacuccgggugcuacauccacuucuuccgggagcccaccgaccugaagcaguucaagcaggacgcgaaguacagccacggcaucgacgugaccgaccucuucgccgcccagcccggccugaccuccgccgucaucgaggcccugccccgcaacauggugaucacgugccaggggagcgaggacauccgcaagcuccuggagucccagggccggaaggacaucaagcugaucgacaucgcgcucagcaagaccgacucccgcaaguucgagaacgccgugugggaccagcacaaggaccugugccacaugcacaccggggucgugguggagaagaagaagcggggcgggaaggaggagaucaccccgcacugcgcccugauggacugcaucauguucgacgccgcggucagcggcggccucaacacgcuggugcugcgcgccgugcucccccgggacauggucuuccgcaccagcacccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5038 - RNA, 1927 nt, Artificial Sequence
  mRNA product Design1 comprising derived and/or modified sequence from Lassa virus__AHC95558__NP (opt1)
gggagaaagcuuaccaugagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagcggcgcgacgacagcgaccugaagcggcugcgcgaccucaaccaggccgugaacaaccugguggagcugaaguccacccagcagaaguccguccuccgggugggcacgcuguccagcgacgaccugcucacccuggccgccgaccuggagaagcucaaguccaaggugauccgcaccgagcggccccugagcuccggggucuacaugggcaaccugagcucccagcagcucgaccagcgccgggcccugcugaacaugaucgggaugaccggcggcaaccagggggcgcaggccggccgcgacgggguggugcgggucugggacgugcgcaacgccgagcuccugaacaaccaguucggcacgaugccgagccugacccucgccugccugaccaagcagggccagguggaccugaacgacgucgugcaggcgcucaccgaccuggggcugaucuacacggccaaguaccccaacaccuccgaccucgaccggcugacccagaaccaccccauccugaacaugaucgacaccaagaaguccagccucaacaucagcggcuacaacuucagccugggggccgccgugaaggccggcgcgugcaugcuggacgggggcaacaugcucgagacgaucaaggucagcccccagagcaucgacggcauccugaaguccauccugaaggugaagcgcacccucgggauguucgugagcgacaccccgggcgagcggaaccccuacgagaacauccuguacaagaucugccuguccggggacggcuggcccuacaucgccagccgcaccuccaucgucgggcgggccugggagaacacggugguggaccucgagaccgaccgcaagagccagggccccaacuccggcaacagcaacaagucccugcagagcgccggguucuccgccggccugaccuacagccagcucaugacccugaaggacgcgaugcugcagcuggacccgaacgccaagacguggauggacaucgaggggcgccccgaggaccccgucgagguggcccucuaccagcccaucuccggcugcuacauccacuucuuccgggagccgaccgaccugaagcaguucaagcaggacgccaaguacagccacgggaucgacaucaccgaccuguucgccgcgcagcccggccucaccuccgccgucaucgaggcccugccccgcaacauggugaucacgugccagggcagcgaggacaucaagaagcugcucgagagccaggggcggaaggacaucaagcugaucgacaucgcccuguccaagaucgacagccgcaaguucgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaacgccagcgugcuccgggcggugcugccgcgggacauggucuuccgcaccuccacccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5039 - RNA, 1927 nt, Artificial Sequence
  mRNA product Design1 comprising derived and/or modified sequence from Lassa virus__AHC95560__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacgcugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcauguccggcgggaaccagggcacccagguggggcgggacggcgugguccgcgugugggacgugaagaacgcggagcuccugaacaaccaguucgggaccaugccgagccugacccucgccugccugaccaagcagggccaggccgaccugaacgacgucgugcaggcccucacggaccugggccugaucuacaccgcgaaguaccccaacgccuccgaccucgaccggcugacccagagccaccccauccugaacaugaucgacaccaagaaguccagccucaacaucagcggguacaacuucucccugggcgccgccgugaaggccggggcgugcaugcuggacggcggcaacaugcucgagacgaucaaggucagcccccaguccauggacgggauccucaagagcauccugaaggugaagcgcgcccugggcauguucguguccgacaccccgggggagcggaaccccuacgagaacauccuguacaagaucugccugagcggcgacggguggcccuacaucgccucccgcaccagcaucgucggccgggccugggagaacaccgugguggaccucgaggccgacggcaaccccaagaagcugaacuccaacgggagcaacaagucccugcagagcgcgggcuucccggccgggcucacguacucccagcugaugacccugaaggacgccaugcugcagcucgaccccaacgccaagaccuggauggacaucgagggccgccccgaggaccccgucgagguggcccuguaccagccgaacagcgggugcuacauccacuucuuccgggagcccaccgaccugaagcaguucaagcaggacgcgaaguacucccacggcaucgacgucacggaccucuucgccgcccagcccggccugaccagcgccgugaucgaggcccugccccgcaacauggugaucacgugccagggguccgaggacauccgcaagcuccuggagagccagggccggaaggacaucaagcugaucgacaucgcgcucuccaagaccgacagccgcaaguucgagaacgccgucugggaccagcacaaggaccugugccacaugcacacgggggugguggucgagaagaagaagcggggcgggaaggaggagaucaccccgcacugcgcccugauggacugcaucauguucgacgccgcggugagcggcggccucaacacccuggugcugcgcgccguccucccccgggacaugguguuccgcaccuccacgcccaaggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5040 - RNA, 1927 nt, Artificial Sequence
  mRNA product Design1 comprising derived and/or modified sequence from Lassa virus__AIT17127__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcaaccagggggugcgggccggcaaggacggggucgugcgcgugugggacgucaagaacgccgagcuccugaacaaccaguucggcaccaugccgucccugacgcucgccugccugaccaagcagggccagguggaccugaacgacgcggugcaggcccucaccgaccuggggcugaucuacaccgccaaguaccccaacacgagcgaccucgaccggcugacccagucccaccccauccugaacaugaucgacaccaagaaguccagccucaacaucuccggcuacaacuucagccugggggccgccgucaaggcgggcgccugcaugcuggacgggggcaacaugcucgagaccaucaaggugagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgccugggagaacacggucguggaccucgaguccgacggcaagccccagaaggcgggcagcaacaacuccaacaagagccugcaguccgccggguucaccgccggccugaccuacagccagcucaugacccugaaggacgccaugcugcagcuggacccgaacacgaagaccuggauggacaucgaggggcggcccgaggaccccguggagaucgcccucuaccagcccuccagcggcugcuacauccacuucuuccgcgagccgaccgaccugaagcaguucaagcaggacgcgaaguacucccacgggaucgacgucaccgaccuguucgccgcccagcccggccucacgagcgccgugaucgacgcccugccccggaacauggugaucacgugccagggcuccgacgacauccgcaagcugcucgagagccaggggcgcaaggacaucaagcugaucgacaucgcgcugaacaagaccgacagccggaaguacgagaacgccgucugggaccaguacaaggaccucugccacaugcacaccggcguggucguggagaagaagaagcgcgggggcaaggaggagaucaccccgcacugcgcccugauggacugcaucauguucgacgccgcgguguccgggggccugaacaccagcguccuccgggccgugcugccccgcgacaugguguuccggaccuccacgccccgcgucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5041 - RNA, 1927 nt, Artificial Sequence
  mRNA product Design1 comprising derived and/or modified sequence from Lassa virus__AIT17131__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacgcugagcuccgacgaccugcucguccuggccgccgaccuggagaagcucaagagcaaggugacccggaccgagcgcccccuguccgccgggguguacaugggcaaccugagcucccagcagcucgaccagcggcgcgcgcugcugaacaugaucgggaugagcggcggcaaccagggggcccgggccggccgcgacggggucgugcgggugugggacgucaagaacgccgagcuccugaacaaccaguucggcaccaugccgucccugacgcucgcgugccugaccaagcagggccagguggaccugaacgacgugguccaggcccucaccgaccuggggcugaucuacaccgccaaguaccccaacacgagcgaccucgaccgccugacccagucccaccccauccugaacaugguggacaccaagaaguccagccucaacaucuccggcuacaacuucagccugggggccgccgugaaggcgggcgccugcaugcuggacgggggcaacaugcucgagaccaucaaggucagcccccagacgaucgacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggccugggagaacacgguggucgaccucgaguccgacggcaagccccagaaggcgggcagcaacaacuccaacaagagccugcaguccgccggguucaccgccggccugaccuacagccagcucaugacccugaaggacgccaugcugcagcuggacccgaacgccaagaucuggauggacaucgaggggcgccccgaggaccccguggagaucgcgcucuaccagcccuccagcggcugcuacauccacuucuuccgggagccgacggaccugaagcaguucaagcaggacgccaaguacucccacgggaucgacgugaccgaccuguucgccgcccagcccggccucaccagcgccgucaucgacgcgcugccccgcaacauggugaucacgugccagggcgccgacgacauccgcaagcugcucgagucccaggggcggaaggacaucaagcugaucgacaucgcccugaacaaggccgacagccgcaaguacgagaacgcggucugggaccaguacaaggaccucugccacaugcacaccggcgugguggucgagaagaagaagcgcgggggcaaggaggagaucaccccgcacugcgcccugauggacugcaucauguucgacgccgccgugagcgggggccugaacaccuccgugcuccgggccguccugccccgggacaugguguuccgcaccagcacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5042 - RNA, 1927 nt, Artificial Sequence
  mRNA product Design1 comprising derived and/or modified sequence from Lassa virus__AIT17139__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggaucguggucgagaagaagaagcggggcgggaaggaggagaucacgccccacugcgcccugauggacugcaucauguucgacgccgccgugagcggcgggcugaacaccuccgugcuccgcgccguccugccgcgggacaugguguuccgcaccaccacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5043 - RNA, 1927 nt, Artificial Sequence
  mRNA product Design1 comprising derived and/or modified sequence from Lassa virus__AIT17143__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcaacaacggcagcaacaagucccugcagagcgccggguucaccgccggccugaccuacucccagcucaugacgcugaaggacgccaugcugcagcuggacccgaacgcgaagaccuggauggacaucgaggggcgccccgaggaccccguggagaucgcccucuaccagcccagcuccggcugcuacauccacuucuuccgggagccgaccgaccugaagcaguucaagcaggacgccaaguacagccacgggaucgacgugaccgaccuguucgccgcccagcccggccucacguccgcggucaucgacgcccugccccgcaaccuggugaucacgugccagggcagcgacgacauccgcaagcuccuggagucccaggggcggaaggacaucaagcugaucgacaucgcccucagcaagaccgacagccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucuccgggggccucaacaccagcgugcugcgggccgugcugccccgggacauggucuuccgcaccuccacgccccggguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5044 - RNA, 1927 nt, Artificial Sequence
  mRNA product Design1 comprising derived and/or modified sequence from Lassa virus__AIT17147__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgagcagcggcgcgcgcugcugaacaugaucgggauguccggcagcaaccagggcgcccaggccgggcgggacggcgucgugcgcgugugggacgucaagaacgccgagcuccugaacaaccaguucgggacgaugccgucccugacccucgcgugccugaccaagcagggccagguggaccugaacgacgccgugcaggcccucaccgaccuggggcugaucuacacggucaaguaccccaacaccagcgaccucgaccggcugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgacaccccgggggagcgcaaccccuacgagaacauccuguacaagaucugccugagcggcgacggguggcccuacaucgccucccggaccagcaucacgggccgcgccugggagaacaccgugguggaccucgaguccgacgggaagccccagaaggcggacagcaacuccagcaacaagucccugcagagcgccggcuucaccgccggccugaccuacucccagcucaugacgcugaaggacgccaugcugcagcuggacccgaacgccaagaccuggauggacaucgaggggcggcccgaggaccccgucgagguggcgcucuaccagcccagcuccggcugcuacauccacuucuuccgcgagccgaccgaccugaagcaguucaagcaggacgccaaguacagccacgggaucgacgugaccgaccuguucgccgcccagcccggccucacguccgccgucaucgacgcgcugccccggaacauggugaucacgugccaggggagcgacgacauccgcaagcugcucgagagccagggccgcaaggacaucaagcugaucgacaucgcccuguccaagaccgacagccggaaguacgagaacgccgucugggaccaguacaaggaccucugccacaugcacaccggcgugguggucgagaagaagaagcgcgggggcaaggaggagaucaccccgcacugcgcccugauggacugcaucauguucgacgcggccguguccgggggccugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5045 - RNA, 1927 nt, Artificial Sequence
  mRNA product Design1 comprising derived and/or modified sequence from Lassa virus__AIT17151__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacguggugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagcugcagaaggcgggcagcaacaacuccaacaagagccugcaguccgccggguucaccgccggccucaccuacagccagcugaugacgcugaaggacgccaugcugcagcucgaccccaacgccaagaccuggauggacaucgaggggcgcccggaggaccccguggagaucgcgcuguaccagcccuccagcggcugcuacauccacuucuuccgggagcccaccgaccugaagcaguucaagcaggacgccaaguacucccacgggaucgacgucaccgaccucuucgccgcccagccgggccugacgagcgccgugaucgacgcgcugccccgcaacauggugaucacgugccagggcuccgacgacauccgcaagcuccuggagagccaggggcggaaggacaucaagcugaucgacaucgcccucaacaagaccgacagccgcaaguacgagaacgccgucugggaccaguacaaggaccugugccacaugcacaccggcguggucguggagaagaagaagaagggcgggaaggaggagaucacgccccacugcgcccugauggacugcaucauguucgacgcggccguguccgggggccucaacaccagcguccugcgggccgugcugccccgcgacaugguguuccggaccuccaccccgcgcgucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5046 - RNA, 1927 nt, Artificial Sequence
  mRNA product Design1 comprising derived and/or modified sequence from Lassa virus__AIT17155__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgagcugcucgugcuggccgccgaccuggagaagcucaaguccaaggugauccggaccgagcgcccccugagcgccggggucuacaugggcaaccuguccagccagcagcucgaccagcggcgcgcgcugcuguccaugaucgggaugagcggcggcaaccagggggcccggaccggccgcgacgggguggugcgggucugggacgugaagaacgccgagcuccugaacaaccaguucggcaccaugccgucccugacccucgccugccugaccaagcagggccagguggaccugaacgacgcgguccaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggggccgccgugaaggcgggcgccugcaugcuggacgggggcaacaugcucgagacgaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgugguggaccucgaguccgacggcaagccccagaaggcgggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccgucgagaucgcgcucuaccagcccuccagcggcugcuacauccacuucuuccgggagccgaccgaccugaagcaguucaagcaggacgccaaguacucccacgggaucgacgugaccgaccuguucgccgcccagcccggccucacgagcgccgugaucgacgcgcugccccgcaacauggucaucacgugccagggcuccgacgacauccgcaagcugcucgagagccaggggcggaaggacaucaagcugaucgacaucgcccugagcaagaucgacucccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgcggccgucagcgggggccugaacucccucgugcugcgggccgugcugccgcgggacauggucuuccgcaccagcacgccccggguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5047 - RNA, 1927 nt, Artificial Sequence
  mRNA product Design1 comprising derived and/or modified sequence from Lassa virus__AIT17161__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggaccgggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccguggucgaccucgaguccgacgggaagccccagaaggcgggcagcaacuccagcaacaagucccugcagagcgccggccugaccgccgggcucacguacucccagcugaugacccugaaggacgccaugcugcagcucgacccgaacgccaagaccuggauggacaucgagggccgccccgaggaccccguggagaucgcgcuguaccagcccagcuccgggugcuacauccacuucuuccgggagccgaccgaccugaagcaguucaagcaggacgccaaguacagccacggcaucgacgugacggaccucuucgccgcccagcccgggcugaccuccgccgucaucgacgcgcugccccgcaaccucgugaucacgugccagggcagcgacgacauccgcaagcugcuggagagccagggccggaaggacaucaagcucaucgacaucgcccuguccaagaccgacagccgcaaguacgagaacgccgugugggaccaguacaaggaccugugccacaugcacaccgggaucgucguggagaagaagaagcggggcgggaaggaggagaucacgccccacugcgcccucauggacugcaucauguucgacgcggccgucuccggcgggcugaacgccagcgugcugcgcgccgugcucccgcgggacauggucuuccgcaccuccacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5048 - RNA, 1927 nt, Artificial Sequence
  mRNA product Design1 comprising derived and/or modified sequence from Lassa virus__AIT17165__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgaggugaacaacgugcagcgccucaugcggaaggagcgccgggacgacaacgaccugaagcgccugcgggaccucaaccaggccgucaacaaccugguggagcugaaguccacccagcagaaguccauccuccgcgugggcacccugaccuccgacgaccugcucauccuggccgccgaccuggagaagcucaagagcaaggucacccggaccgagcgcccccuguccgccgggguguacaugggcaaccugagcucccagcagcucgaccagcggcgcgcgcugcugaacaugaucgggaugagcaacggcaaccagggcacgcgggccgggcgcgacggcgugguccgggugugggacgugaagaacgccgagcuccugaacaaccaguucgggaccaugccgucccugacccucgccugccugaccaagcagggccaggucgaccugaacgacguggugcaggcgcucacggaccuggggcugaucuacaccgccaaguaccccaacaccagcgaccucgaccgccugacccagucccaccccauccugaacaugaucgacacgaagaaguccagccucaacaucagcggcuacaacuucagccugggcgccgccgucaaggccggggcgugcaugcuggacggcgggaacaugcucgagaccaucaaggugagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccgucguggaccucgaguccgacgggaagccccagaaggccgacagcuccaacagcaacaagucccugcagagcgcgggcuucaccgccggccugacguacucccagcucaugacccugaaggacgccaugcugcagcuggacccgaacgccaagaccuggauggacaucgaggggcgccccgaggaccccguggaggucgcccucuaccagcccagcuccggcugcuacauccacuucuuccgggagccgaccgaccugaagcaguucaagcaggacgcgaaguacagccacgggaucgacgugacggaccuguucgccgcccagcccggccucaccuccgccgugaucgacgcccugccccgcaacauggucaucacgugccaggggagcgacgacauccgcaagcugcucgagucccagggccggaaggacaucaagcugaucgacaucgcgcugagcaaggccgacagccgcaaguacgagaacgccgugugggaccagcacaaggaccucugccacaugcacaccggcgucgugguggagaagaagaagcgcgggggcaaggaggagaucaccccgcacugcgcccugauggacugcaucauguacgacgcggccgucuccgggggccugaacaccagcgugcuccgggccgugcugccccgggacauggucuuccgcaccuccacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5049 - RNA, 1927 nt, Artificial Sequence
  mRNA product Design1 comprising derived and/or modified sequence from Lassa virus__AIT17169__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcuccggcaaccagcgggcccaggccggccgcgacggggugguccgggugugggacgugaagaacgucgagcuccugaacaaccaguucggcaccaugccgagccugacgcucgccugccugaccaagcagggccagguggaccugaacgacgcggugcaggcccucaccgaccuggggcugaucuacaccgccaaguaccccaacacguccgaccucgaccgccugacccagagccaccccauccugaacaugaucgacaccaagaaguccagccucaacaucagcggguacaacuucucccugggcgccgccgucaaggcgggcgccugcaugcuggacgggggcaacaugcucgagaccaucaaggugagcccccagacgauggacgggauccugaaguccauccugaaggugaagaaggcccucggcauguucaucagcgacaccccgggcgagcggaaccccuacgagaacauccuguacaagaucugccuguccggggacggcuggcccuacaucgccagccgcaccuccaucaccgggcgggccugggagaacacggucguggaccucgagagcgacggcaagccccagaaggcgggguccaacaacagcaacaagucccugcagagcgugggcuucaccgccggccugaccuacucccagcucaugacccugaaggacgccaugcugcagcuggacccgaacgccaagacguggauggacaucgaggggcgccccgaggaccccgucgagaucgcccucuaccagcccagcuccggcugcuacauccacuucuuccgggagccgaccgaccugaagcaguucaagcaggacgcgaaguacagccacgggaucgacgugaccgaccuguucgccgcccagcccggccucaccuccgccgugaucgacgcccugccccgcaacauggucaucacgugccaggggagcgacgacauccgcaagcugcucgagagccagggccggaaggacaucaagcugaucgacaucgcgcuguccaagaccgacagccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgccgcggucuccgggggccugaacaccagcgugcuccgggccgugcugccgcgggacauggucuuccgcaccuccacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5050 - RNA, 1927 nt, Artificial Sequence
  mRNA product Design1 comprising derived and/or modified sequence from Lassa virus__AIT17173__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgggacauggucuuccgcaccagcacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5051 - RNA, 1927 nt, Artificial Sequence
  mRNA product Design1 comprising derived and/or modified sequence from Lassa virus__AIT17177__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucgugcuggccgccgaccuggagaagcucaaguccaaggugauccggaccgagcgcccccugagcgccgggaucuacaugggcaaccuguccagccagcagcucgaccagcggcgcgcgcugcugaacaugaucgggauguccggcggcaaccagggggcccgggccggccgcgacggggucgugcgggugugggacgucaagaacgccgaccuccugaacaaccaguucggcaccaugccgagccugacgcucgcgugccugaccaagcagggccagguggaccugaacgacgugguccaggcccucaccgaccuggggcugaucuacaccgccaaguaccccaacacguccgaccucgaccgccugacccagagccaccccauccugaagaugaucgacgccaacaaguccagccucaacaucagcggcuacaacuucucccugggggccgcggugaaggccggcgccugcaugcuggacgggggcaacaugcucgagaccaucaaggugagcccccagaccauggacggcauccugaaguccauccugaaggucaagaagucccucgggauguucaucagcgacacgccgggcgagcggaaccccuacgagaacauccuguacaagaucugccugagcggggacggcuggcccuacaucgccucccgcaccagcaucaucgggcgggccugggagaacaccgugguggaccucgaguccgacggcaagccccagaagaccggcagcaacaacuccagcaagucccugcagagcgcgggguucgccgccggccugacguacucccagcucaugacccugaaggacgccaugcugcagcuggacccgaacgccaagaccuggauggacaucgaggggcgccccgaggaccccgucgagaucgcgcucuaccagcccagcuccggcugcuacauccacuucuuccgggagccgaccgaccugaagcaguucaagcaggacgccaaguacagccacgggaucgacgugacggaccuguucgccgcccagcccggccucaccuccgccgugaucgaggcgcugccccgcaacauggucaucacgugccagggcagcgacgacauccgcaagcugcucgagagccaggggcggaaggacaucaagcugaucgacaucgcccuguccaagaccgacagccgcaaguacgagaacgccgugugggaccaguacaaggaccucugccacaugcacaccggcaucgucguggagaagaagaagcgcgggggcaaggaggagaucacgccccacugcgcccugauggacugcaucauguucgacgcggccguguccgggggccugaacacccucguccugcgggccgugcugccgcgggacaugguguuccgcaccagcacccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5052 - RNA, 1927 nt, Artificial Sequence
  mRNA product Design1 comprising derived and/or modified sequence from Lassa virus__AIT17181__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacaacgaccugaagcgccugcgggaccucaaccaggccgugaacaaccugguggagcucaagagcacccagcagaaguccguccugcgcgugggcacccugaccagcgacgaccugcucgugcuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcauccaggggacccggacgggccgcgacggggugguccgggugugggacgugaagaacgccgaccuccugaacaaccaguucggcaccaugccgagccugacccucgccugccugaccaagcaggggcaggucgaccugaacgacguggugcaggcccucacggaccugggccugaucuacaccgcgaaguaccccaacgccuccgaccucgaccgccugacccagagccaccccauccugaacaugaucgacaccaagaaguccagccucaacaucagcggcuacaacuucucccugggggccgccgucaaggccggcgcgugcaugcuggacgggggcaacaugcucgagacgaucaaggugagcccccagaccauggacggcauccugaaguccauccugaaggugaagaagacccucgggauguucaucagcgacaccccgggcgagcggaaccccuacgagaacauccuguacaagaucugccuguccggggacggcuggcccuacaucgccagccgcacguccaucaccgggcgggccugggagaacaccgucguggaccucgagagcgacggcaagccccagaaggccggcuccaacaacagcaacaagucccugcagagcgccggguucgcggccggccugaccuacucccagcucaugacgcugaaggacgccaugcugcagcuggacccgaacgccaagaccuggauggacaucgaggggcgccccgaggaccccguggagaucgcccucuaccagcccagcuccggcugcuacauccacuucuuccgggagccgaccgaccugaagcaguucaagcaggacgcgaaguacagccacgggaucgacgucaccgaccuguucgccgcccagcccggccucacguccgccgugaucgaggcccugccccgcaacauggucaucacgugccagggcagcgacgacaucaagaagcugcucgagucccaggggcgcaaggacaucaagcugaucgacaucgcgcugagcaagaccgacagccggaaguacgagaacgccgugugggaccaguacaaggaccucugccacaugcacaccggcguggucguggagaagaagaagcgcgggggcaaggaggagaucaccccgcacugcgcccugauggacugcaucauguucgacgccgcgguguccgggggccugaacacccucguccugcgggccgugcugccccgcgacaugguguuccggaccagcacgccccgcgucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5053 - RNA, 1927 nt, Artificial Sequence
  mRNA product Design1 comprising derived and/or modified sequence from Lassa virus__AIT17185__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcucaagagcacccagcagaaguccgugcugcgcgucgggacccugaccagcgacgaccugcucauccuggccgccgaccuggagaagcucaaguccaaggugacccggaccgagcgcccccugagcgccggcguguacauggggaaccuguccagccagcagcucgaccagcggcgcgcgcugcugaacaugaucggcauguccggcgggaaccggggcgcccgcacggggaaggacggcgucgugcggaucugggacgugaagaacgccgaccuccugaacaaccaguucgggaccaugccgagccugacccucgccugccugaccaagcagggccaggucgaccugaacgacguggugcaggcgcucacggaccugggccugaucuacaccgccaaguaccccaacaccuccgaccucgaccgccugacccagagccaccccauccugaacaugaucgacacgaacaaguccagccucaacaucagcggguacaacuucucccugggcgccgccgucaaggccggggcgugcaugcuggacggcggcaacaugcucgagaccaucaaggugagcccccagaccauggacgggauccugaaguccauccugaaggugaagaagucccucggcauguucaucagcgacaccccgggggagcggaaccccuacgagaacauccuguacaagaucugccugagcggcgacggguggcccuacaucgccucccgcacgagcaucaccggccgggccugggagaacaccgucguggaccucgaguccgacgagaagccccagaaggccggcagcaacaacuccaacaagagccugcaguccaccggguucacggccggccugaccuacagccagcucaugacccugaaggacgcgaugcugcagcuggacccgaacgccaagaccuggauggacaucgaggggcgccccgaggaccccguggagaucgcccucuaccagcccuccagcggcugcuacauccacuucuuccgggagccgacggaccugaagcaguucaagcaggacgccaaguacucccacgggaucgacgucaccgaccuguucgccgcgcagcccggccucaccagcgccgugaucgacacccugccccgcaacauggugaucacgugccagggcuccgacgacauccgcaagcugcucgagagccaggggcggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucacgccccacugcgcccugauggacugcaucauguucgacgcggccgugagcgggggccugaacgccuccguccuccgggccgugcugccgcgggacaugguguuccgcaccagcacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5054 - RNA, 1927 nt, Artificial Sequence
  mRNA product Design1 comprising derived and/or modified sequence from Lassa virus__AIT17189__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggaccggccgcgacggggucgugcgggugugggacgucaagaacgccgagcuccugaacaaccaguucggcaccaugccgucccugacccucgccugccugaccaagcagggccagguggaccugaacgacgugguccaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggugagcccccagaccaucgacggcauccucaagagcauccugaaggucaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgugguggaccucgaguccgacggcaagccccagaaggccggcagcaacaacuccaacaagagccugcaguccgcgggguucaccgccggccugacguacagccagcucaugacccugaaggacgccaugcugcagcuggacccgaacgccaagaccuggauggacaucgaggggcgccccgaggaccccgucgagaucgcccucuaccagcccuccagcggcugcuacauccacuucuuccgggagccgaccgaccugaagcaguucaagcaggacgcgaaguacucccacgggaucgacgugacggaccuguucgccgcccagcccggccucaccagcgccgugaucgacgcccugccccgcaacauggucaucacgugccagggcuccgacgacauccgcaagcugcucgagagccaggggcggaaggacaucaagcugaucgacaucgcgcugagcaagaccgacucccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgccgcggucagcgggggccugaacucccucgugcugcgggccgugcugccgcgggacauggucuuccgcaccagcacgccccggguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5055 - RNA, 1927 nt, Artificial Sequence
  mRNA product Design1 comprising derived and/or modified sequence from Lassa virus__AIT17193__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggaccggccgcgacggggucgugcgggugugggacgucaagaacgccgagcuccugaacaaccaguucggcaccaugccgucccugacccucgccugccugaccaagcagggccagguggaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgucaaggcgggcgccugcaugcuggacgggggcaacaugcucgagaccaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgucguggaccucgaguccgacggcaagccccagaaggcgggcaacaacaacagcaacaagucccugcagagcgccggguucaccgccggccugacguacucccagcucaugacccugaaggacgccaugcugcagcuggacccgaacgccaagaccuggauggacaucgaggggcgccccgaggaccccguggagaucgcgcucuaccagcccagcuccggcugcuacauccacuucuuccgggagccgaccgaccugaagcaguucaagcaggacgccaaguacagccacgggaucgacgucacggaccuguucgccgcccagcccggccucaccuccgccgugaucgacgcgcugccccgcaacauggugaucacgugccagggcagcgacgacauccgcaagcugcucgagucccaggggcggaaggacaucaagcugaucgacaucgcccugagcaagaccgacagccgcaaguacgagaacgccgucugggaccaguacaaggaccucugccacaugcacaccggcguggucguggagaagaagaagcgcgggggcaaggaggagaucacgccccacugcgcccugauggacugcaucauguucgacgcggccguguccgggggccugaacagccucguccugcgggccgugcugccgcgggacaugguguuccgcaccuccacgccccgggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5056 - RNA, 1927 nt, Artificial Sequence
  mRNA product Design1 comprising derived and/or modified sequence from Lassa virus__AIT17197__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccugucccuccagcagcuggaccagcggcgcgcgcugcucaacaugaucgggaugagcggcuccaaccagggcgugcgggccgggcgcgacggcgucgugcgggugugggacgucaagaacgccgagcugcugaacaaccaguucgggaccaugccgagccucacgcuggccugccugaccaagcagggccagguggaccucaacgacgcggugcaggcccugaccgaccuggggcucaucuacaccgccaaguaccccaacacguccgaccuggaccgccugacccagagccaccccauccucaacaugaucgacaccaagaaguccagccugaacaucagcggcuacaacuucucccugggcgccgccgucaaggcgggggccugcaugcucgacggcgggaacaugcuggagaccaucaaggugagcccccagacgauggacggcauccugaaguccauccucaaggugaagaaggcccugggcauguucaucagcgacaccccgggggagcggaaccccuacgagaacauccuguacaagaucugccucuccggcgacggguggcccuacaucgccagccgcaccuccaucaccggccgggccugggagaacacggucguggaccuggagagcgacgggaagccccagaaggcgggcuccaacggcagcaacaagucccugcagagcgccggguucaccgccggccucaccuacucccagcugaugacccugaaggacgccaugcugcagcucgacccgaacgccaagacguggauggacaucgaggggcgccccgaggaccccguggagaucgcgcuguaccagcccagcuccggcugcuacauccacuucuuccgggagccgaccgaccugaagcaguucaagcaggacgccaaguacagccacgggaucgacgucaccgaccucuucgccgcccagcccggccugaccuccgccgugaucgacgcgcugccccgcaacauggugaucacgugccagggcagcgacgacauccgcaagcuccuggagucccaggggcggaaggacaucaagcugaucgacaucgcccucagcaagaccgacagccgcaaguacgagaacgccgucugggaccaguacaaggaccugugccacaugcacaccggcaucguggucgagaagaagaagcgcgggggcaaggaggagaucacgccccacugcgcccugauggacugcaucauguucgacgcggccguguccgggggccucaacaccagcgugcugcgggccguccugccgcgggacaugguguuccgcaccuccacgccccgggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5057 - RNA, 1927 nt, Artificial Sequence
  mRNA product Design1 comprising derived and/or modified sequence from Lassa virus__AIT17201__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacaucaagaagcuguucgagagccaggggcgcaaggacaucaagcucaucgacaucgcccugagcaagaccgacucccggaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgcgacauggucuuccggaccagcacgccccgcguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5058 - RNA, 1927 nt, Artificial Sequence
  mRNA product Design1 comprising derived and/or modified sequence from Lassa virus__AIT17205__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggaaggcgcugcugaacaugaucgggauguccggcagcaaccagggcgcccgcaucgggcgggacggcgugguccgcgugugggacgugaagaacgccgagcuccugaacaaccaguucgggacgaugccgucccugacccucgccugccugaccaagcagggccaggucgaccugaacgacgcggugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggucagcccccagaccauggacggcauccucaagagcauccugaaggugaagaaggcccugggcauguucaucuccgacaccccgggggagcgcaaccccuacgagaacauccuguacaagaucugccugagcggcgacggguggcccuacaucgccucccggaccagcaucacgggccgcgccugggagaacaccguggucgaccucgaguccgacgggaagccccagaaggcgggcagcaacuccagcaacaagucccugcagagcgccggccugaccgccgggcucaccuacucccagcugaugacgcugaaggacgccaugcugcagcucgacccgaacgccaagaccuggauggacaucgagggccggcccgaggaccccguggagaucgcgcuguaccagcccagcuccgggugcuacauccacuucuuccgcgagccgaccgaccugaagcaguucaagcaggacgccaaguacagccacggcaucgacgugaccgaccucuucgccgcccagcccgggcugacguccgccgucaucgacgcgcugccccggaaccucgugaucacgugccagggcagcgacgacauccgcaagcugcuggagagccagggccgcaaggacaucaagcucaucgacaucgcccuguccaagaccgacagccggaaguacgagaacgccgugugggaccaguacaaggaccugugccacaugcacaccgggaucgucguggagaagaagaagcgcggcgggaaggaggagaucaccccgcacugcgcccucauggacugcaucauguucgacgcggccgucuccggcgggcugaacgccagcgugcugcgggccgugcucccccgcgacauggucuuccggaccuccacgccccgcguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5059 - RNA, 1927 nt, Artificial Sequence
  mRNA product Design1 comprising derived and/or modified sequence from Lassa virus__AIT17209__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacguggugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagcugcagaagaccggcagcaacaacuccaacaagagccugcaguccgcgggguucaccgccggccucacguacagccagcugaugacccugaaggacgccaugcugcagcucgaccccaacgccaagaucuggauggacaucgaggggcgcccggaggaccccguggagaucgcccuguaccagcccuccagcggcugcuacauccacuucuuccgggagcccaccgaccugaagcaguucaagcaggacgcgaaguacucccacgggaucgacgucaccgaccucuucgccgcccagccgggccugacgagcgccgugaucgacgcccugccccgcaacauggugaucacgugccagggcuccgacgacauccgcaagcuccuggagagccaggggcggaaggacaucaagcugaucgacaucgcgcucaacaagaccgacagccgcaaguacgagaacgccgucugggaccaguacaaggaccugugccacaugcacaccggcguggucguggagaagaagaagaagggcgggaaggaggagaucacgccccacugcgcccugauggacugcaucauguucgacgccgcgguguccgggggccucaacaccagcguccugcgggccgugcugccccgcgacaugguguuccggaccuccaccccgcgcgucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5060 - RNA, 1927 nt, Artificial Sequence
  mRNA product Design1 comprising derived and/or modified sequence from Lassa virus__AIT17211__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccaggccggccgggacggggugguccgcgugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccggcugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaaguccauccugaaggugaagaaggcccucgggauguucaucagcgacaccccgggcgagcgcaaccccuacgagaacauccuguacaagaucugccuguccggggacggcuggcccuacaucgccagccggaccuccaucacggggcgcgcgugggagaacaccguggucgaccucgagagcgacggcaagccccagaaggccaacuccaacagcuccaacaagagccugcaguccgccggcuucaccgccgggcugaccuacagccagcucaugacgcugaaggacgccaugcugcagcuggacccgaacgcgaagaccuggauggacaucgagggccggcccgaggaccccguggagaucgcccucuaccagcccuccagcgggugcuacauccacuucuuccgcgagccgaccgaccugaagcaguucaagcaggacgccaaguacucccacggcaucgacgugaccgaccuguucgccgcccagcccgggcucacgagcgcggucaucgacgcccugccccggaacauggugaucacgugccagggcuccgacgacauccgcaagcugcucgagagccagggccgcaaggacaucaagcugaucgacaucgcccugagcaagaccgacucccggaaguacgagaacgccgugugggaccaguacaaggaccucugccacaugcacaccgggaucgucguggagaagaagaagcgcggcgggaaggaggagaucaccccgcacugcgcgcugauggacugcaucauguucgacgccgccgucagcggcgggcugaacaccuccgugcuccgggccgugcugccccgcgacauggucuuccggaccagcacgccccgcguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5061 - RNA, 1927 nt, Artificial Sequence
  mRNA product Design1 comprising derived and/or modified sequence from Lassa virus__AIT17213__NP (opt1)
gggagaaagcuuaccaugagcgccuccaaggagaucaagagcuuccuguggacccagucccuccgccgggagcuggccggcuacugcagcaacaucaagcuccagguggucaaggacgcgcaggcccugcugcacgggcuggacuucuccgaggugagcaacgugcagcgccucaugcggaaggagcgccgggacgacaacgaccugaagcgccugcgggaccucaaccaggccgucaacaaccugguggagcugaaguccacccagcagaaguccgugcuccgcgucggcacccugaccagcgacgaccugcucauccuggccgccgaccuggagaagcucaagagcaaggugauccggaccgagcgcccccuguccgcggggguguacaugggcaaccugagcucccagcagcucgaccagcggcgcgcccugcugaacaugaucgggaugagcggcuccaaccagggcguccgggccgggcgcgacggcguggugcgggucugggacgugaagaacgccgagcuccugaacaaccaguucgggaccaugccgagccugacgcucgcgugccugaccaagcagggccagguggaccugaacgacgccguccaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggcgccgcggugaaggccggggccugcaugcuggacggcgggaacaugcucgagaccaucaaggugagcccccagacgauggacggcauccugaaguccauccugaaggucaagaaggcccucggcauguucaucagcgacaccccgggggagcggaaccccuacgagaacauccuguacaagaucugccuguccggcgacggguggcccuacaucgccagccgcaccuccaucaccggccgggcgugggagaacacggugguggaccucgagagcgacgggaagccccagaaggccggcuccaacggcagcaacaagucccugcagagcgccggguucaccgccggccugaccuacucccagcucaugacccugaaggacgccaugcugcagcuggacccgaacgcgaagacguggauggacaucgaggggcgccccgaggaccccgucgagaucgcccucuaccagcccagcuccggcugcuacauccacuucuuccgggagccgaccgaccugaagcaguucaagcaggacgccaaguacagccacgggaucgacgugaccgaccuguucgccgcccagcccggccucaccuccgcggugaucgacgcccugccccgcaacauggucaucacgugccagggcagcgacgacauccgcaagcugcucgagucccaggggcggaaggacaucaagcugaucgacaucgcccugagcaagaccgacagccgcaaguacgagaacgccgugugggaccaguacaaggaccucugccacaugcacaccggcaucgucguggagaagaagaagcgcgggggcaaggaggagaucacgccccacugcgcgcugauggacugcaucauguucgacgccgccguguccgggggccugaacaccagcguccuccgggccgugcugccgcgggacaugguguuccgcaccuccacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5062 - RNA, 1927 nt, Artificial Sequence
  mRNA product Design1 comprising derived and/or modified sequence from Lassa virus__AIT17217__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcuccggcgugcagggcgcccgggccgggcgcgacggcgucgugcgggugugggacgucaagaacgccgagcuccugaacaaccaguucgggacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggugagcccccagaccauggacggcauccugaaguccauccugaaggucaagaaggcccucggcauguucaucagcgagaccccgggggagcggaaccccuacgagaacauccuguacaagaucugccuguccggcgacggguggcccuacaucgccagccgcaccuccaucacgggccgggccugggagaacaccgugguggaccucgagagcgacgggaagccccagaaggcgggcuccaacaacagcaacaagucccugcagagcaccggcuucgccgccgggcugaccuacucccagcucaugacgcugaaggacgccaugcugcagcuggacccgaacgccaagaccuggauggacaucgagggccgccccgaggaccccgucgagguggcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgucaucgacgcgcugccccgcaacauggugaucacgugccagggcagcgacgacaucaagaagcugcucgagagccagggccgcaaggacaucaagcugaucgacaucgcccuguccaagaccgacagccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccguguccggcgggcugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5063 - RNA, 1927 nt, Artificial Sequence
  mRNA product Design1 comprising derived and/or modified sequence from Lassa virus__AIT17225__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcugaacaugaucgggauguccggcggcaaccagggggcccgggccggcaacgacgggguggugcgcgucugggacgugaagaacgccgaccuccugaacaaccaguucggcacgaugccgagccugacccucgcgugccugaccaagcagggccagguggaccugaacgacgucgugcaggcccucaccgaccuggggcugaucuacacggccaaguaccccaacaccuccgaccucgaccggcugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggucagcccccagaccauggacggcauccugaaguccauccugaaggugaagaaggcccucgggauguucaucagcgacaccccgggcgagcgcaaccccuacgagaacauccuguacaagaucugccuguccggggacggcuggcccuacaucgccagccggaccuccaucacggggcgcgccugggagaacaccguggucgaccucgagagcgacggcaagccccagaagaccggcaacaacuccagcaacaagucccugcagagcgcgggguucaccgccggccugacguacucccagcucaugacccugaaggacgccaugcugcagcuggacccgaacgccaagaccuggauggacaucgaggggcggcccgaggaccccguggagguggcccucuaccagcccagcuccggcugcuacauccacuucuuccgcgagccgaccgaccugaagcaguucaagcaggacgcgaaguacagccacgggaucgacgucacggaccuguucgccgcccagcccggccucaccuccgccgugaucgaggcccugccccggaacauggucaucacgugccagggcagcgacgacauccgcaagcugcucgagucccaggggcgcaaggacaucaagcugaucgacaucgcgcugagcaagaucgacagccggaaguacgagaacgccgugugggaccaguacaaggaccucugccacaugcacaccggcguggucguggagaagaagaagcgcgggggcaaggaggagaucacgccccacugcgcccugauggacugcaucauguucgacgccgcgguguccgggggccugaacacccucguccugcgggccgugcugccgcgcgacaugguguuccggaccagcacccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5064 - RNA, 1927 nt, Artificial Sequence
  mRNA product Design1 comprising derived and/or modified sequence from Lassa virus__AIT17229__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcuguccaugaucgggaugagcggcggcaaccaggggacccgggccggccgcgacggggucgugcgggugugggacgucaagaacgccgagcuccugaacaaccaguucggcaccaugccgucccugacccucgccugccugaccaagcagggccagguggaccugaacgacgcggugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagccccagaaggcgggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccguggagaucgcgcucuaccagcccuccagcggcugcuacauccacuucuuccgggagccgaccgaccugaagcaguucaagcaggacgccaaguacucccacgggaucgacgucaccgaccuguucgccgcccagcccggccucacgagcgccgugaucgacgcgcugccccgcaacauggugaucacgugccagggcuccgacgacauccgcaagcugcucgagagccaggggcggaaggacaucaagcugaucgacaucgcccugagcaaggccgacucccgcaaguacgagaacgccgucugggaccaguacaaggaccucugccacaugcacaccggcguggucguggagaagaagaagcgcgggggcaaggaggagaucacgccccacugcgcgcugauggacugcaucauguucgacgccgccgugagcgggggccugaacaccuccguccuccgggccgugcugccgcgggacaugguguuccgcaccagcacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5065 - RNA, 1927 nt, Artificial Sequence
  mRNA product Design1 comprising derived and/or modified sequence from Lassa virus__AIT17233__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaaggagcgccgggacgacaacgaccugaagcgccugcgggaccucaaccaggccgugaacaaccugguggagcucaagagcacccagcagaaguccauccugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagggggcccaggccggccgggacgggguggugcgcgucugggacgugaagaacgccgagcuccugaacaaccaguucggcacgaugccgucccugacccucgcgugccugaccaagcagggccagguggaccugaacgacgccguccaggcccucaccgaccuggggcugaucuacacggccaaguaccccaacaccagcgaccucgaccggcugacccagucccaccccauccugaacaugaucgacaccaagaaguccagccucaacaucagcggcuacaacuucagccugggggccgcggugaaggccggcgccugcaugcuggacgggggcaacaugcucgagacgaucaaggugagcccccagaccauggacggcauccucaagagcauccugaaggucaagaaggcccuggggauguucaucuccgacaccccgggcgagcgcaaccccuacgagaacauccuguacaagaucugccugagcggggacggcuggcccuacaucgccucccggaccagcaucacggggcgcgcgugggagaacaccgugguggaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcggcccgaggaccccgucgagguggcccucuaccagcccuccagcggcugcuacauccacuucuuccgcgagccgaccgaccugaagcaguucaagcaggacgccaaguacucccacgggaucgacgugaccgaccuguucgccgcccagcccggccucacgagcgcggucaucgacgcccugccccggaacauggugaucacgugccagggcuccgacgacauccgcaagcugcucgagagccaggggcgcaaggacaucaagcugaucgacaucgcccugagcaagaccgacucccggaaguacgagaacgccgucugggaccaguacaaggaccucugccacaugcacaccggcgugguggucgagaagaagaagcgcgggggcaaggaggagaucaccccgcacugcgcgcugauggacugcaucauguucgacgccgccgugagcgggggccugaacaccuccgugcuccgggccguccugccccgcgacaugguguuccggaccagcacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5066 - RNA, 1927 nt, Artificial Sequence
  mRNA product Design1 comprising derived and/or modified sequence from Lassa virus__AIT17237__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagacgaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagguggcccucuaccagcccuccagcggcugcuacauccacuucuuccgggagccgaccgaccugaagcaguucaagcaggacgccaaguacucccacgggaucgacgucaccgaccuguucgccgcccagcccggccucacgagcgcggugaucgacgcccugccccgcaacauggugaucacgugccagggcuccgacgacauccgcaagcugcucgagagccaggggcggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucaccccgcacugcgcgcugauggacugcaucauguucgacgccgccgugagcgggggccugaacaccuccguccuccgggccgugcugccccgggacaugguguuccgcaccagcacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5067 - RNA, 1927 nt, Artificial Sequence
  mRNA product Design1 comprising derived and/or modified sequence from Lassa virus__AIT17241__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagacgaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcccagcccggccucacgagcgcggucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcgucguggucgagaagaagaagcgcgggggcaaggaggagaucaccccgcacugcgcgcucauggacugcaucauguucgacgccgccgugagcgggggccugaacaccuccgugcugcgggccguccucccccgggacaugguguuccgcaccagcacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5068 - RNA, 1927 nt, Artificial Sequence
  mRNA product Design1 comprising derived and/or modified sequence from Lassa virus__AIT17245__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggacggggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccguggucgaccucgaguccgacgggaagccccagaaggcgggcagcaacaacuccaacaagagccugcaguccgccggccugaccgccgggcucacguacagccagcugaugacccugaaggacgccaugcugcagcucgacccgaacgccaagaccuggauggacaucgagggccgccccgaggaccccguggagaucgcgcuguaccagcccuccagcgggugcuacauccacuucuuccgggagccgaccgaccugaagcaguucaagcaggacgccaaguacucccacggcaucgacguggccgaccucuucgccgcccagcccgggcugacgagcgcggucaucgacgcccugccccgcaaccucgugaucacgugccagggcuccgacgacauccgcaagcugcuggagagccagggccggaaggacaucaagcucaucgacaucgcccugagcaagaccgacucccgcaaguacgagaacgccgugugggaccaguacaaggaccugugccacaugcacaccgggaucgucguggagaagaagaagcggggcgggaaggaggagaucaccccgcacugcgcgcucauggacugcaucauguucgacgccgccgucagcggcgggcugaacgccuccgugcugcgcgccgugcucccccgggacauggucuuccgcaccagcacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5069 - RNA, 1927 nt, Artificial Sequence
  mRNA product Design1 comprising derived and/or modified sequence from Lassa virus__AIT17247__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucauccuggccgccgaccuggagaagcucaagagcaaggugauccggaccgagcgcccccuguccagcgggguguacaugggcaaccuguccagccagcagcucgaccagcggcgcgcccugcugaacaugaucgggauguccggcggcaaccagggggcgcaggucggccgggacgggguggugcgcgucugggacgugaagaacgccgaccuccugaacaaccaguucggcaccaugccgagccugacgcucgccugccugaccaagcagggccagguggaccugaacgacgucgugcaggcccucaccgaccuggggcugaucuacaccgcgaaguaccccaacacguccgaccucgaccggcuggcccagagccaccccauccugaacaugaucgacaccaagaaguccagccucaacaucagcggcuacaacuucucccugggggccgccgugaaggccggcgcgugcaugcuggacgggggcaacaugcucgagaccaucaaggucagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaaggccggcuccaacaacagcaacaagucccugcagagcgcgggguucacggccggccugaccuacucccagcucaugacccugaaggacagcaugcugcagcuggacccgaacgccaagaccuggauggacaucgaggggcggcccgaggaccccgucgagguggcccucuaccagcccuccagcggcugcuacauccacuucuuccgcgagccgacggaccugaagcaguucaagcaggacgccaaguacucccacgggaucgacgugaccgaccuguucgcggcccagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgcggucugggaccaguacaaggaccucugccacaugcacaccggcgugguggucgagaagaagaagcgcgggggcaaggaggagaucacgccccacugcgcccugauggacugcaucauguucgacgccgccguguccgggggccugaagacccucgugcugcgggcgguccugccgcgcgacaugguguuccggaccagcacccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5070 - RNA, 1927 nt, Artificial Sequence
  mRNA product Design1 comprising derived and/or modified sequence from Lassa virus__AIT17251__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucauccuggccgccgaccuggagaagcucaagagcaaggugauccggaccgagcgcccccuguccagcgggguguacaugggcaaccuguccagccagcagcucgaccagcggcgcgcccugcugaacaugaucgggauguccggcggcaaccagggggcgcaggucggccgggacgggguggugcgcgucugggacgugaagaacgccgaccuccugaacaaccaguucggcaccaugccgagccugacgcucgccugccugaccaagcagggccagguggaccugaacgacgucgugcaggcccucaccgaccuggggcugaucuacaccgcgaaguaccccaacacguccgaccucgaccggcuggcccagagccaccccauccugaacaugaucgacaccaagaaguccagccucaacaucagcggcuacaacuucucccugggggccgccgugaaggccggcgcgugcaugcuggacgggggcaacaugcucgagaccaucaaggucagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaagacgggcuccaacaacagcaacaagucccugcagagcgccggguucaccgcgggccugaccuacucccagcucaugacccugaaggacagcaugcugcagcuggacccgaacgccaagacguggauggacaucgaggggcggcccgaggaccccgucgagguggcccucuaccagcccuccagcggcugcuacauccacuucuuccgcgagccgaccgaccugaagcaguucaagcaggacgccaaguacucccacgggaucgacgugaccgaccuguucgccgcgcagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgccgucugggaccaguacaaggaccucugccacaugcacaccggcgugguggucgagaagaagaagcgcgggggcaaggaggagaucacgccccacugcgcgcugauggacugcaucauguucgacgccgccguguccgggggccugaagacccucgugcugcgggccguccugccgcgcgacaugguguuccggaccagcacccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5071 - RNA, 1927 nt, Artificial Sequence
  mRNA product Design1 comprising derived and/or modified sequence from Lassa virus__AIT17255__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagcgggcccaggccgggcgcgacggcguggugcgggucugggacgugaagaacgccgagcuccugaacaaccaguucgggacgaugccgucccugacccucgcgugccugaccaagcagggccagguggaccugaacgacgccguccaggcccucaccgaccuggggcugaucuacacggugaaguaccccaacgccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagaccaucaaggucagcccccagacgauggacggcauccucaagagcauccugaaggugaagaagacccugggcauguucaucuccgacaccccgggggagcggaaccccuacgagaacauccuguacaagaucugccugagcggcgacggguggcccuacaucgccucccgcaccagcaucacgggccgggccugggagaacaccguggucgaccucgaguccaacgggaagccccagaaggcggacagcaacuccagcaacaagucccugcagagcgccggcuucaccgccggccugaccuacucccagcucaugacgcugaaggacgccaugcugcagcuggacccgaacgccaagaccuggauggacaucgaggggcgccccgaggaccccguggagaucgcguucuaccagcccagcuccggcugcuacauccacuucuuccgggagccgaccgaccucaagcaguucaagcaggacgccaaguacagccacgggaucgacgugaccgaccuguucgccgcccagcccggccugacguccgccgucaucgacgcgcucccccgcaacauggugaucacgugccaggggagcgacgacauccgcaagcugcuggagagccagggccggaaggacaucaagcucaucgacaucgcccuguccaagaccgacagccgcaaguacgagaacgccgucugggaccaguacaaggaccugugccacaugcacaccggcgugguggucgagaagaagaagcgcgggggcaaggaggagaucaccccgcacugcgcccucauggacugcaucauguucgacgcggccguguccgggggccugaacacccuggugcuccgggccguccugccccgggacaugguguuccgcaccagcacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5072 - RNA, 1927 nt, Artificial Sequence
  mRNA product Design1 comprising derived and/or modified sequence from Lassa virus__AIT17259__NP (opt1)
gggagaaagcuuaccaugagcgccuccaaggagaucaagagcuuccuguggacccagucccuccgccgggagcugagcuccuacugcagcaacaucaagcuccagguggucaaggacgcccaggcgcugcugcacggccuggacuucuccgaggugagcaacgugcagcgccucaugcggaaggagcgccgggacgacaacgaccugaagcgccugcgggaccucaaccaggccgucaacaaccugguggagcugaaguccacccagcagaaguccauccuccgcguggggacccugaccagcgacgaccugcucauccuggccgccgaccuggagaagcucaagagcaaggucacccggaccgagcgcccccuguccgccggcguguacauggggaaccugagcucccagcagcucgaccagcggcgcgcgcugcugaacaugcucggcaugagcggguccaaccagggcgcccgggccggccgcgacggggugguccgggugugggacgugaagaacgccgagcugcugaacaaccaguucggcacgaugccgagccucacccuggcgugccugaccaagcaggggcaggucgaccucaacgacgccgugcaggcccugaccgaccugggccucaucuacacggccaaguaccccaacaccuccgaccuggaccgccugacccagagccaccccauccucaacaugaucgacaccaagaaguccagccugaacaucagcggguacaacuucucccugggcgccgcggugaaggccggcgccugcaugcucgacgggggcaacaugcuggagacgaucaaggucagcccccagaccauggacgggauccugaaguccauccucaaggugaagaaggcccugggcauguucaucagcgacaccccgggcgagcggaaccccuacgagaacauccuguacaagaucugccucuccggggacggcuggcccuacaucgccagccgcaccuccaucacggggcgggcgugggagaacaccguggucgaccuggagagcgacggcaagccccagaaggccggguccaacagcuccaacaagagccugcaguccgccggcuucaccgccggccucaccuacagccagcugaugacgcugaaggacgccaugcugcagcucgacccgaacgcgaagaccuggauggacaucgaggggcgccccgaggaccccguggagaucgcccuguaccagcccuccagcggcugcuacauccacuucuuccgggagccgaccgaccugaagcaguucaagcaggacgccaaguacucccacgggaucgacgugaccgaccucuucgccgcccagcccggccugacgagcgcggucaucgacgcccugccccgcaacauggugaucacgugccaggggagcgacgacauccgcaagcuccuggagucccagggccggaaggacaucaagcugaucgacaucgcccucagcaagaccgacucccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucagcgggggccucaacgccuccgugcugcgggccgugcugccccgggacauggucuuccgcaccagcacgccccggguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5073 - RNA, 1927 nt, Artificial Sequence
  mRNA product Design1 comprising derived and/or modified sequence from Lassa virus__AIT17263__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacggucguggaccucgagagcgacggcaagccccagaaggccggcuccaacgggagcaacaagucccugcagagcgccggcuucaccgccgggcugaccuacucccagcucaugacccugaaggacgccaugcugcagcuggacccgaacacgaagaccuggauggacaucgagggccgccccgaggaccccguggaggucgcgcucuaccagcccagcuccgggugcuacauccacuucuuccgggagccgaccgaccugaagcaguucaagcaggacgccaaguacagccacggcaucgacgugaccgaccuguucgccgcccagcccggccucacguccgccgugaucgacgcgcugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucgucguggagaagaagaagcggggcgggaaggaggagaucaccccgcacugcgcccugauggacugcaucauguucgacgcggccguguccggcggccugaacaccagcguccuccgcgccgugcugccccgggacaugguguuccgcaccuccacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5074 - RNA, 1927 nt, Artificial Sequence
  mRNA product Design1 comprising derived and/or modified sequence from Lassa virus__AIT17267__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggguggucguggagaagaagaagcggggcgggaaggaggagaucacgccccacugcgcccugauggacugcaucauguucgacgccgccgugagcggcgggcugaacaccuccguccuccgcgccgugcugccgcgggacaugguguuccgcaccaccacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5075 - RNA, 1927 nt, Artificial Sequence
  mRNA product Design1 comprising derived and/or modified sequence from Lassa virus__AIT17271__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaagaccauccugaaggugaagaaggcccucgggauguucaucuccgacaccccgggcgagcggaaccccuacgagaacauccuguacaagaucugccugagcggggacggcuggcccuacaucgccucccgcacgagcaucaccgggcgggcgugggagaacaccguggucgaccucgaguccgacggcaagccccagaagaccggcagcaacaacuccaacaagagccugcaguccgccggguucgccgccggccugacguacagccagcucaugacccugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugacggaccuguucgccgcccagcccggccucaccagcgcggucaucgacgcccugccccgcaacauggugaucacgugccagggcuccgacgacauccgcaagcugcucgagagccaggggcggaaggacaucaagcugaucgacaucgcccuguccaaggccgacagccgcaaguacgagaacgcggugugggaccaguacaaggaccucugccacaugcacaccggcgucguggucgagaagaagaagcgcgggggcaaggaggagaucaccccgcacugcgcccugauggacugcaucauguacgacgccgccgugagcgggggccuguccaccagcgugcuccgggccguccugccccgggacaugguguuccgcaccuccacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5076 - RNA, 1927 nt, Artificial Sequence
  mRNA product Design1 comprising derived and/or modified sequence from Lassa virus__AIT17275__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcugaaguccacccagcagaaguccgugcuccgcgucgggacgcugaccagcgacgaccugcucacccuggccgccgaccuggagaagcucaaguccaaggugacccggacggagcgcccccugagcgccggcguguacauggggaaccuguccagccagcagcucgaccagcggcgcgcgcugcugaacaugaucggcauguccggcgggaaccagggcgcccggaccgggaaggacggcgucgugcgcaucugggacgugaagaacgccgaccuccugaacaaccaguucgggaccaugccgagccugacccucgccugccugacgaagcagggccaggucgaccugaacgacguggugcaggcgcucaccgaccugggccugaucuacaccgccaaguaccccaacaucuccgaccucgaccggcuggcccagagccaccccauccugaagaugaucgacaccuccaagagcagccucaacaucuccggguacaacuucagccugggcgccgccgucaaggcgggggccugcaugcuggacggcggcaacaugcucgagacggugaaggugagcccccagaccauggacgggauccucaagagcauccugaaggucaagaagucccugggcauguucaucagcgacaccccgggggagcgcaaccccuacgagaacauccuguacaagaucugccuguccggcgacggguggcccuacaucgccagccggaccuccaucacgggccgcgccugggagaacaccgugguggaccucgagagcgacggcaagccccagaaggucggguccaacaacagcaacaagucccugcagagcaccggcuucaccgccgggcugacguacucccagcucaugacccugaaggacgcgaugcugcagcuggacccgaacgccaagaccuggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugacggaccuguucgccgcgcagcccggccucaccuccgccgucaucgacacccugccccggaacauggugaucacgugccaggggagcgacgacaucggcaagcugcucgagagccaggggcgcaaggacaucaagcugaucgacaucgcccuguccaagaccgacagccgcaaguacgagaacgccgucugggaccaguacaaggaccucugccacaugcacaccggcgugguggucgagaagaagaagcgcgggggcaaggaggagaucaccccgcacugcgcccugauggacugcaucauguucgacgcggccguguccggcgggcugaacgccagcgugcuccgggccguccugccccgggacaugguguuccgcaccuccacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5077 - RNA, 1927 nt, Artificial Sequence
  mRNA product Design1 comprising derived and/or modified sequence from Lassa virus__AIT17277__NP (opt1)
gggagaaagcuuaccaugagcgccuccaaggagaucaagagcuuccuguggacccagucccuccgccgggagcugagcuccuacugcagcaacaucaagcuccagguggucaaggacgcccaggcgcugcugcacggccuggacuucuccgaggugagcaacgugcagcgccucaugcggaaggagcgccgggacgacaacgaccugaagcgccugcgggaccucaaccaggccgucaacaaccugguggagcugaaguccacccagcagaaguccauccuccgcguggggacccugaccuccgacgaccugcucauccuggccgccgaccuggagaagcucaagagcaaggucacccggaccgagcgcccccuguccgccggcguguacauggggaaccugagcucccagcagcucgaccagcggcgcgcgcugcugagcaugaucggcauguccgggagcaaccagggcgcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagagccaccccauccugaacaugaucgacaccaagaaguccagccucaacaucuccggguacaacuucagccugggcgccgcggugaaggccggcgccugcaugcuggacgggggcaacaugcucgagacgaucaaggucagcccccagaccauggacgggauccucaagagcauccugaaggugaagaaggcccugggcauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccgggagcaacaacuccaacaagagccugcaguccgccggcuucaccgccggccugaccuacagccagcucaugacgcugaaggacgccaugcugcagcuggacccgaacgcgaagaccuggauggacaucgaggggcgccccgaggaccccguggagguggcccucuaccagcccuccagcggcugcuacauccacuucuuccgggagccgaccgaccugaagcaguucaagcaggacgccaaguacucccacgggaucgacgucaccgaccuguucgccgcccagcccggccucacgagcgcggugaucgacgcccugccccgcaacauggugaucacgugccaggggagcgacgacauccgcaagcugcucgagucccagggccggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucaccccgcacugcgcgcugauggacugcaucauguucgacgccgccgugagcgggggccugaacaccuccguccuccgggccgugcugccccgggacaugguguuccgcaccagcacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5078 - RNA, 1927 nt, Artificial Sequence
  mRNA product Design1 comprising derived and/or modified sequence from Lassa virus__AIT17281__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggcccgggccggccgcgacgggguggugcggaucugggacgucaagaacgccgagcuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccuccaccacgaacagcaacaagucccugcagagcgcgggcuucgccgccgggcugaccuacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgacggaccugaagcaguucaagcaggacgccaaguacagccacggcaucgacgucaccgaccuguucgccgcccagcccgggcucaccuccgccgugaucgacacccugccccgcaacauggugaucacgugccagggcagcgaggacauccgccggcugcucgagagccagggccgcaaggacaucaagcugaucgacaucgcgcuguccaagaccgacagccggaaguacgagaacgccgucugggaccaguacaaggaccucugccacaugcacaccgggguggucguggagaagaagaagaagggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5079 - RNA, 1927 nt, Artificial Sequence
  mRNA product Design1 comprising derived and/or modified sequence from Lassa virus__AIT17285__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgcagcaugcggaaggagcgccgggacgacaacgaccucaagcgccugcgggaccugaaccaggccgucaacaaccucguggagcugaaguccacccagcagaaguccauccugcgcgugggcacccucaccagcgacgaccugcugauccucgccgccgaccuggagaagcucaagagcaaggucacccggaccgagcgcccccuguccgccgggguguacaugggcaaccugagcucccagcagcuggaccagcggcgcgcgcuccugaacaugaucgggaugagcggcuccaaccagggcgcccgggccgggcgcgacggcgugguccgggugugggacgugaagaacgccgagcugcucaacaaccaguucgggacgaugccgagccugacccuggcgugccucaccaagcagggccaggucgaccugaacgacguggugcaggcccugaccgaccucgggcugaucuacacggccaaguaccccaacgccuccgaccuggaccgccucacccagagccaccccauccugaacaugaucgacaccaagaaguccagccugaacaucagcggcuacaacuucucccucggcgccgcggucaaggccggggccugcaugcuggacggcgggaacaugcuggagaccaucaaggugagcccccagacgauggacggcauccucaaguccauccugaaggugaagaaggcccugggcauguucaucagcgacaccccgggggagcggaaccccuacgagaacauccucuacaagaucugccuguccggcgacggguggcccuacaucgccagccgcaccuccaucaccggccgggcgugggagaacacgaucgucgaccuggagagcgacgggaagccccagaaggccggcaacaacggcuccaacaagagccuccaguccgccggguucaccgccggccugaccuacagccagcugaugacccucaaggacgccaugcugcagcuggacccgaacgcgaagacguggauggacaucgaggggcgccccgaggaccccguggagaucgcccuguaccagcccuccagcggcugcuacauccacuucuuccgggagccgaccgaccucaagcaguucaagcaggacgccaaguacucccacgggaucgacgugaccgaccuguucgccgcccagcccggccugaccagcgcggucaucgacgcccucccccgcaaccuggugaucacgugccagggcuccgacgacauccgcaagcugcucgagagccaggggcggaaggacaucaagcugaucgacaucgcccugagcaagaccgacucccgcaaguacgagaacgccgugugggaccaguacaaggaccucugccacaugcacaccggcaucgucguggagaagaagaagcgcgggggcaaggaggagaucacgccccacugcgcgcugauggacugcaucauguucgacgccgccgucagcgggggccugaacaccuccgugcuccgggccgugcugccgcgggacauggucuuccgcaccagcacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5080 - RNA, 1927 nt, Artificial Sequence
  mRNA product Design1 comprising derived and/or modified sequence from Lassa virus__AIT17289__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggugcgggccggccgcgacggggugguccggaucugggacgugaagaacgccgagcuccugaacaaccaguucggcacgaugccgagccugacccucgccugccugaccaagcagggccagguggaccugaacgacgucgugcaggcgcucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggccggcgcgugcaugcuggacgggggcaacaugcucgagacgaucaaggucagcccccagaccauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccggcuccaucaacagcaacaagucccugcagagcaccggguucgccgcgggccugacguacucccagcucaugacccugaaggacgccaugcugcagcuggacccgaacgccaagaccuggauggacaucgaggggcgccccgaggaccccgucgagaucgcccucuaccagcccagcuccggcugcuacauccacuucuuccgggagccgaccgaccugaagcaguucaagcaggacgccaaguacagccacgggaucgacgugacggaccuguucgcggcccagcccggccucaccuccgccgugaucgacgcccugccccgcaacauggucaucacgugccagggcagcgacgacauccgcaagcugcucgagagccaggggcggaaggacaucaagcugaucgacaucgcccuguccaagaccgacagccgcaaguacgagaacgcggugugggaccaguacaaggaccucugccacaugcacaccggcaucgucguggagaagaagaagcgcgggggcaaggaggagaucaccccgcacugcgcccugauggacugcaucauguucgacgccgccguguccgggggccugaacaccagcguccuccgggcggugcugccccgggacaugguguuccgcaccuccacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5081 - RNA, 1927 nt, Artificial Sequence
  mRNA product Design1 comprising derived and/or modified sequence from Lassa virus__AIT17293__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaaguccaaggugacccggaccgagcgcccccugagcgccggggucuacaugggcaaccuguccacgcagcagcucgaccagcggcgcgcgcugcugaacaugaucgggaugagcggcggcaaccagggggcccgggccggccgcgacgggguggugcgggucugggacgugaagaacgccgaccuccugaacaaccaguucggcaccaugccgucccugacccucgcgugccugaccaagcagggccagguggaccugaacgacgucgugcaggcccucacggaccuggggcugaucuacaccgccaaguaccccaacaccagcgaccucgaccgccugacccagucccaccccauccugaacaugaucgacacgaacaagagcucccucaacaucagcggcuacaacuucagccugggggccgccgugaaggcgggcgccugcaugcuggacgggggcaacaugcucgagaccaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccguggucgaccucgaguccgacggcaagccccagaaggcgggcgggaacaacagcaacaagucccugcagagcgccggcuucaccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgugacggaccuguucgccgcccagcccggccucaccuccgccgucaucgacgcgcugccccgcaacauggugaucacgugccaggggagcgacgacauccgcaagcugcucgagucccagggccggaaggacaucaagcugaucgacaucgcccugagcaagaccgacucccgcaaguacgagaacgccgucugggaccaguacaaggaccucugcaacaugcacaccgggaucgugguggagaagaagaagcggggcgggaaggaggagaucaccccgcacugcgcccugauggacugcaucauguucgacgcggccgucagcggcggcaugaacaccagcgugcugcgcgccgugcucccccgggacauggucuuccgcaccuccacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5082 - RNA, 1927 nt, Artificial Sequence
  mRNA product Design1 comprising derived and/or modified sequence from Lassa virus__AIT17295__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacgaucgucgaccucgagagcgacggcaagccccagaaggccggcuccaacgggagcaacaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccgcccagcccggccucaccuccgcgaucaucgacgcccugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucguggucgagaagaagaagcggggcgggaaggaggagaucacgccccacugcgcgcugauggacugcaucauguucgacgccgccguguccggcggccugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5083 - RNA, 1927 nt, Artificial Sequence
  mRNA product Design1 comprising derived and/or modified sequence from Lassa virus__AIT17299__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagggggcccggacgggccgcgacgggguggugcgggucugggacgugaagaacgccgagcuccugaacaaccaguucggcaccaugccgucccugacccucgccugccugaccaagcagggccagguggaccugaacgacgucgugcaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccguggucgaccucgaguccgacggcaagccccagaaggccggcagcaacaacuccaacaagagccugcaguccgcgggguucaccgccggccugacguacagccagcucaugacccugaaggacgccaugcugcagcuggacccgaacgccaagaccuggauggacaucgaggggcgccccgaggaccccguggagaucgcccucuaccagcccuccagcggcugcuacauccacuucuuccgggagccguccgaccugaagcaguucaagcaggacgcgaaguacagccacgggaucgacgugaccgaccuguucgccgcccagcccggccucacguccgccgucaucgacgcccugccccgcaacauggugaucacgugccagggcagcgacgacauccgcaagcuguucgagagccaggggcggaaggacaucaagcucaucgacaucgcgcuguccaagaccgacagccgcaaguacgagaacgccgucugggaccaguacaaggaccugugccacaugcacaccggcgugguggucgagaagaagaagcgcgggggcaaggaggagaucaccccgcacugcgcccucauggacugcaucauguucgacgccgcgguguccgggggccugaacagccuggugcuccgggccguccugccccgggacaugguguuccgcaccuccacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5084 - RNA, 1927 nt, Artificial Sequence
  mRNA product Design1 comprising derived and/or modified sequence from Lassa virus__AIT17303__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcugguccagagccaccccauccugaacaugaucgacaccaagaaguccagccucaacaucagcggcuacaacuucucccugggggccgccgugaaggccggcgccugcaugcuggacgggggcaacaugcucgagaccaucaaggugagcccccagaccauggacggcauccugaaguccauccugaaggucaagaaggcgcucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaaggccggcuccaacaacagcaacaagucccugcagagcgccggguucacggcgggccugaccuacucccagcucaugacccugaaggacagcaugcugcagcuggacccgaacgccaagaccuggauggacaucgaggggcggcccgaggaccccguggaggucgcccucuaccagcccuccagcggcugcuacauccacuucuuccgcgagccgacggaccugaagcaguucaagcaggacgccaaguacucccacgggaucgacgugaccgaccuguucgccgcgcagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaagacccucgugcugcgggccgugcugccgcgcgacauggucuuccggaccagcacccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5085 - RNA, 1927 nt, Artificial Sequence
  mRNA product Design1 comprising derived and/or modified sequence from Lassa virus__AIT17307__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacgcugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggacgggccgcgacggggucgugcgggugugggacgucaagaacgccgagcuccugaacaaccaguucggcaccaugccgucccugacccucgccugccugaccaagcagggccagguggaccugaacgacgugguccaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgugguggaccucgaguccgacggcaagcugcagaagaccggcagcaacaacuccaacaagagccugcaguccgccggguucacggcgggccucaccuacagccagcugaugacccugaaggacgccaugcugcagcucgaccccaacgccaagaucuggauggacaucgaggggcgcccggaggaccccgucgagaucgcccuguaccagcccuccagcggcugcuacauccacuucuuccgggagcccaccgaccugaagcaguucaagcaggacgccaaguacucccacgggaucgacgugacggaccucuucgcggcccagccgggccugaccagcgccgugaucgacgcccugccccgcaacauggucaucacgugccagggcuccgacgacauccgcaagcuccuggagagccaggggcggaaggacaucaagcugaucgacaucgcccucaacaagaccgacagccgcaaguacgagaacgcggugugggaccaguacaaggaccugugccacaugcacaccggcgucgugguggagaagaagaagaagggcgggaaggaggagaucacgccccacugcgcccugauggacugcaucauguucgacgccgccgucuccgggggccucaacaccagcgugcugcgggcggugcugccccgcgacauggucuuccggaccuccaccccgcgcguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5086 - RNA, 1927 nt, Artificial Sequence
  mRNA product Design1 comprising derived and/or modified sequence from Lassa virus__AIT17311__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacggucguggaccucgagagcgacggcaagccccagaaggccggcuccaacgggagcaacaagucccugcagagcgccggcuucaccgccgggcugaccuacucccagcucaugacccugaaggacgccaugcugcagcuggacccgaacgcgaagacguggauggacaucgagggccgccccgaggaccccguggaggucgcccucuaccagcccagcuccgggugcuacauccacuucuuccgggagccgaccgaccugaagcaguucaagcaggacgccaaguacagccacggcaucgacgugaccgaccuguucgccgcccagcccggccucaccuccgcggugaucgacgcccugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucgucguggagaagaagaagcggggcgggaaggaggagaucacgccccacugcgcgcugauggacugcaucauguucgacgccgccguguccggcggccugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5087 - RNA, 1927 nt, Artificial Sequence
  mRNA product Design1 comprising derived and/or modified sequence from Lassa virus__AIT17315__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgucgugcgggugugggacgucaagaacguggagcuccugaacaaccaguucgggacgaugccgucccugacccucgccugccugaccaagcagggccagguggaccugaacgacgcgguccaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgacaccccgggggagcggaaccccuacgagaacauccuguacaagaucugccugagcggcgacggguggcccuacaucgccucccgcaccagcaucacgggccgggccugggagaacaccgugguggaccucgaguccgacgggaagccccagaaggcgggcagcaacuccagcaacaagucccugcagagcgccggcuucaccgccgggcugaccuacucccagcucaugacgcugaaggacgccaugcugcagcuggacccgaacgccaagaccuggauggacaucgagggccgccccgaggaccccgucgagaucgcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgugaucgacgcgcugccccgcaacauggucaucacgugccagggcagcgacgacauccgcaagcugcucgagagccagggccggaaggacaucaagcugaucgacaucgcccuguccaagaccgacagccgcaaguacgagaacgccgugugggaccaguacaaggaccucugccacaugcacaccgggaucgucguggagaagaagaagaagggcuccaaggaggagaucaccccgcacugcgcccugauggacugcaucauguucgacgcggccgugagcgggggccugaacgccuccguccuccgggccgugcugccccgcgacaugguguuccggaccagcacgccccgcgucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5088 - RNA, 1927 nt, Artificial Sequence
  mRNA product Design1 comprising derived and/or modified sequence from Lassa virus__AIT17319__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggacaugcucaacaaccaguucggcaccaugccgagccugacgcuggccugccucaccaagcaggggcaggucgaccugaacgacguggugcaggcccugaccgaccucggccugaucuacaccgcgaaguaccccaacacguccgaccuggaccggcucgcccagagccaccccauccugaacaugaucgacaccaagaaguccagccugaacaucagcggcuacaacuucucccucggggccgccgucaaggccggcgcgugcaugcuggacgggggcaacaugcuggagaccaucaaggugagcccccagaccauggacggcauccucaaguccauccugaaggugaagaaggcccuggggauguucaucagcgagacgccgggcgagcgcaaccccuacgagaacauccucuacaagaucugccuguccggggacggcuggcccuacaucgccagccggaccuccaucaccgggcgcgccugggagaacaccaucgucgaccuggagagcgacggcaagccccagaaggccggcuccaacaacagcaacaagucccuccagagcgcgggguucacggccggccugaccuacucccagcugaugacccucaaggacagcaugcugcagcuggacccgaacgccaagaccuggauggacaucgaggggcggcccgaggaccccguggagguggcccuguaccagcccuccagcggcugcuacauccacuucuuccgcgagccgacggaccucaagcaguucaagcaggacgccaaguacucccacgggaucgacgucaccgaccuguucgcggcccagcccggccugaccagcgccgugaucgaggcccucccccggaacauggucaucacgugccagggcagcgacgacauccgcaagcugcuggagucccaggggcgcaaggacaucaagcucaucgacaucgugcugaacaagaccgacagccggaaguacgagaacgccgugugggaccaguacaaggaccugugccacaugcacaccggcgucgugguggagaagaagaagcgcgggggcaaggaggagaucacgccccacugcgcgcucauggacugcaucauguucgacgccgccgucuccgggggccugaagaccauggugcugcgggccgugcucccgcgcgacauggucuuccggaccagcacccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5089 - RNA, 1927 nt, Artificial Sequence
  mRNA product Design1 comprising derived and/or modified sequence from Lassa virus__AIT17323__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcuggcccagagccaccccauccugaacaugaucgacaccaagaaguccagccucaacaucagcggcuacaacuucucccugggggccgccgucaaggccggcgcgugcaugcuggacgggggcaacaugcucgagaccaucaaggugagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucgucgaccucgagagcgacggcaagccccagaaggccggcuccaacaacagcaacaagucccugcagagcgcgggguucacggccggccugaccuacucccagcucaugacccugaaggacagcaugcugcagcuggacccgaacgccaagaccuggauggacaucgaggggcggcccgaggaccccguggagguggcccucuaccagcccuccagcggcugcuacauccacuucuuccgcgagccgacggaccugaagcaguucaagcaggacgccaaguacucccacgggaucgacgucaccgaccuguucgcggcccagcccggccucaccagcgccgugaucgaggcccugccccggaacauggucaucacgugccagggcagcgacgacauccgcaagcugcucgagucccaggggcgcaaggacaucaagcugaucgacaucgcccugaacaagaccgacagccggaaguacgagaacgcggugugggaccaguacaaggaccucugccacaugcacaccggcguggucguggagaagaagaagcgcgggggcaaggaggagaucacgccccacugcgcccugauggacugcaucauguucgacgccgccguguccgggggccugaagacccucguccugcgggcggugcugccgcgcgacaugguguuccggaccagcacccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5090 - RNA, 1927 nt, Artificial Sequence
  mRNA product Design1 comprising derived and/or modified sequence from Lassa virus__AIT17325__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcugaacaugaucgggaugacgggcggcucccgcggggcccaggccggcggggacggcguggugcgggucugggacgugaagaacgccgaccuccugaacaaccaguucgggaccaugccgagccugacccucgcgugccugaccaagcagggccagguggaccugaacgacgucgugcaggcccucacggaccugggccugaucuacaccgccaaguaccccaacaccuccgaccucgaccggcugacccagagccaccccauccugaacaugaucgacacgaagaaguccagccucaacaucagcggguacaacuucucccugggcgccgccgugaaggcgggggccugcaugcuggacggcggcaacaugcucgagaccaucaaggucagcccccagaccauggacgggauccugaaguccauccugaaggugaagaagucccucggcauguucaucagcgacaccccgggggagcgcaaccccuacgagaacauccuguacaagaucugccugagcggcgacggguggcccuacaucgccucccggacgagcaucaccggccgcgccugggagaacaccguggucgaccucgaguccgacggcaagccccagaaggccgggggcaacaacagcaacaagucccugcagagcgcgggguucaccgccggccugacguacucccagcucaugacccugaaggacaccaugcugcagcuggacccgaacgccaagaccuggauggacaucgaggggcggcccgaggaccccguggagguggcccucuaccagcccagcuccggcugcuacauccacuucuuccgcgagccgacggaccugaagcaguucaagcaggacgccaaguacagccacggcaucgacgucaccgaccuguucgcggcccagcccgggcucaccuccgccgugaucgaggcccugccccggaacauggucaucacgugccagggcagcgacgacauccgcaagcugcucgagucccaggggcgcaaggacaucaagcugaucgacaucgcccugagcaagguggacagccggaaguacgagaacgcggugugggaccaguacaaggaccucugccacaugcacaccggcgucgugguggagaagaagaagcgcgggggcaaggaggagaucacgccccacugcgcccugauggacugcaucauguucgacgccgccgucuccggcgggcugaacacccucgugcugcgggcggugcugccgcgcgacauggucuuccggaccagcacccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5091 - RNA, 1927 nt, Artificial Sequence
  mRNA product Design1 comprising derived and/or modified sequence from Lassa virus__AIT17329__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccagaccgucaacaaccugguggagcugaaguccacccagcagaaguccauccuccgcgugggcacccugaccagcgacgaccugcucauccuggccgccgaccuggagaagcucaagagcaaggucauccggaccgagcgcccccuguccgccgggguguacaugggcaaccugagcucccagcagcucgaccagcggcgcgcccugcugaacaugaucgggaugagcuccggcaaccagggcgcgcaggccgggcgggacggcgugguccgcgugugggacgugaagaacgccgagcuccugaacaaccaguucgggacgaugccgagccugacccucgccugccugaccaagcagggccaggucgaccugaacgacgcggugcaggcccucaccgaccuggggcugaucuacacggccaaguaccccaacaccuccgaccucgaccggcugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggucagcccccagaccauggacggcauccugaaguccauccugaaggugaagaaggcccucggcauguucaucagcgacaccccgggggagcgcaaccccuacgagaacauccuguacaagaucugccuguccggcgacggguggcccuacaucgccagccggaccuccaucacgggccgcgccugggagaacaccguggucgaccucgagagcgacgggaugccccagaaggcgggcuccagcuccagcaacaagucccugcagagcgccggcuucguggccgggcugaccuacucccagcucaugacccugaaggacgccaugcugcagcuggacccgaacgccaagacguggauggacaucgagggccggcccgaggaccccguggagaucgcgcucuaccagcccagcuccgggugcuacauccacuucuuccgcgagccgaccgaccugaagcaguucaagcaggacgccaaguacagccacggcaucgacgucaccgaccuguucgccgcccagcccgggcucaccagcgccgugaucgacgcgcugccccggaacauggugaucacgugccagggcuccgacgacauccgcaagcugcucgagagccagggccgcaaggacaucaagcugaucgacaucgcccuguccaaggccgacagccggaaguacgagaacgccgucugggaccaguacaaggaccucugccacaugcacaccgggguggucguggagaagaagaagcgcggcgggaaggaggagaucacgccccacugcgcgcugauggacugcaucauguacgacgccgccguguccggcgggcugaacaccagcguccuccgggccgugcugccgcgcgacaugguguuccggaccuccacgccccgcgucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5092 - RNA, 1927 nt, Artificial Sequence
  mRNA product Design1 comprising derived and/or modified sequence from Lassa virus__AIT17333__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggaucguggucgagaagaagaagcggggcgggaaggaggagaucacgccccacugcgcccugauggacugcaucauguucgacgccgccgugagcggcgggcugaacaccuccgugcuccgcgccguccugccgcgggacaugguguuccgcaccagcacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5093 - RNA, 1927 nt, Artificial Sequence
  mRNA product Design1 comprising derived and/or modified sequence from Lassa virus__AIT17335__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccauccuccgcgugggcacccugaccuccgacgaccugcucauccuggccgccgaccuggagaagcucaagagcaaggucacccggaccgagcgcccccuguccgccgggguguacaugggcaaccugagcucccagcagcucgaccagcggcgcgcgcugcugagcaugaucgggauguccagcggcgugcagggcgcccgggccgggcgcgacggcgucgugcgggugugggacgucaagaacgccgagcuccugaacaaccaguucgggacgaugccgucccugacccucgcgugccugaccaagcagggccagguggaccugaacgacgugguccaggcccucaccgaccuggggcugaucuacacggccaaguaccccaacaccagcgaccucgaccgccugacccagagccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgagaccccgggggagcggaaccccuacgagaacauccuguacaagaucugccugagcggcgacggguggcccuacaucgccucccgcaccagcaucacgggccgggccugggagaacaccgugguggaccucgaguccgacgggaagccccagaaggcgggcagcaacaacuccaacaagagccugcaguccaccggcuucgccgccgggcugaccuacagccagcucaugacgcugaaggacgccaugcugcagcuggacccgaacgccaagaccuggauggacaucgagggccgccccgaggaccccgucgagguggcgcucuaccagcccuccagcgggugcuacauccacuucuuccgggagccgaccgaccugaagcaguucaagcaggacgccaaguacucccacggcaucgacgugaccgaccuguucgccgcccagcccgggcucacgagcgccgucaucgacgcgcugccccgcaacauggugaucacgugccagggcagcgacgacaucaagaagcugcucgagucccagggccgcaaggacaucaagcugaucgacaucgcccugagcaagaccgacucccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccgugagcggcgggcugaacaccuccgugcuccgggccguccugccccgcgacaugguguuccggaccagcacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5094 - RNA, 1927 nt, Artificial Sequence
  mRNA product Design1 comprising derived and/or modified sequence from Lassa virus__AIT17341__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaaguccauccugaaggugaagaaggcccucgggauguucaucagcgacgccccgggcgagcggaaccccuacgagaacauccuguacaagaucugccuguccggggacggcuggcccuacaucgcgagccgcaccuccaucaccgggcgggccugggagaacacgguggucgaccucgagagcgacggcaagccccagaaggccggcuccaacgggagcaacaagucccugcagagcgccggcuucaccgccgggcugaccuacucccagcucaugacccugaaggacgcgaugcugcagcuggacccgaacgccaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccgcgcagcccggccucaccuccgccgucaucgacgcccugccccgcaacauggugaucacgugccaggggagcgacgacauccgcaagcuguucgagucccagggccggaaggacaucaagcucaucgacaucgcccugagcaaggcggacagccgcaaguacgagaacgccgugugggaccaguacaaggaccugugccacaugcacaccggggucguggucgagaagaagaagcggggcgggaaggaggagaucacgccccacugcgcccucauggacugcaucauguucgacgccgccguguccggcggccugaacaccagcgugcugcgcgcgguccucccgcgggacaugguguuccgcaccuccacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5095 - RNA, 1927 nt, Artificial Sequence
  mRNA product Design1 comprising derived and/or modified sequence from Lassa virus__AIT17345__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcuccggcgugcagggcgcccgggccgggcgcgacggcgucgugcgggugugggacgucaagaacgccgagcuccugaacaaccaguucgggacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggugagcccccagaccauggacggcauccugaaguccauccugaaggucaagaaggcccucggcauguucaucagcgagaccccgggggagcggaaccccuacgagaacauccuguacaagaucugccuguccggcgacggguggcccuacaucgccagccgcaccuccaucacgggccgggccugggagaacaccgugguggaccucgagagcgacgggaagccccagaaggcgggcuccaacaacagcaacaagucccugcagagcgccggcuucaccgccgggcugaccuacucccagcucaugacgcugaaggacgccaugcugcagcuggacccgaacgccaagaccuggauggacaucgagggccgccccgaggaccccgucgagguggcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgucaucgacgcgcugccccgcaacauggugaucacgugccagggcagcgacgacaucaagaagcugcucgagagccagggccgcaaggacaucaagcugaucgacaucgcccuguccaagaccgacagccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccguguccggcgggcugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5096 - RNA, 1927 nt, Artificial Sequence
  mRNA product Design1 comprising derived and/or modified sequence from Lassa virus__AIT17351__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcucaagagcacccagcagaaguccgugcugcgcgucgggacccugaccagcgacgaccugcucauccuggccgccgaccuggagaagcucaaguccaaggugauccggaccgagcgcccccugagcgccggcguguacauggggaaccuguccagccagcagcucgagcagcggcgcgcgcugcugaacaugaucggcauguccagcggcaaccagggggcccggaccggcaaggacggggucgugcgcaucugggacgugaagaacgccgaccuccugaacaaccaguucggcaccaugccgucccugacccucgccugccugaccaagcaggggcaggucgaccugaacgacguggugcaggcgcucaccgaccugggccugaucuacacggccaaguaccccaacaccagcgaccucgaccggcugacccagucccaccccauccugaacauggucgacaccagcaagagcucccucaacaucagcggcuacaacuucucccugggggccgccgugaaggccggcgcgugcaugcuggacgggggcaacaugcucgagacgaucaaggugagcccccagaccauggacggcauccugaaguccauccugaaggucaagaagucccucgggauguucgugagcgacaccccgggcgagcgcaaccccuacgagaacauccuguacaagaucugccugagcggggacggcuggcccuacaucgccucccggaccagcaucacggggcgcgccugggagaacaccguggucgaccucgaguccaacggcaagccccagaaggccggcagcaacaacuccaacaagagccugcaguccaccggguucaccgccggccugacguacagccagcucaugacccugaaggacgcgaugcugcagcuggacccgaacgccaagaccuggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugacggaccuguucgccgcgcagcccggccucaccagcgccgucaucgacacccugccccggaacauggugaucacgugccagggcagcgacgacauccgcaagcugcucgagucccaggggcgcaaggacaucaagcugaucgacaucgcccugagcaagaucgacucccggaaguacgagaacgccgucugggaccaguacaaggaccucugccacaugcacaccggcgugguggucgagaagaagaagcgcgggggcaaggaggagaucacgccccacugcgcccugauggacugcaucauguucgacgcggccgugagcgggggccugaacgccuccgugcuccgggccguccugccgcgcgacaugguguuccggaccagcacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5097 - RNA, 1927 nt, Artificial Sequence
  mRNA product Design1 comprising derived and/or modified sequence from Lassa virus__AIT17359__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccauccuccgcgugggcacccugaccagcgacgaccugcucauccuggccgccgaccuggagaagcucaagagcaaggucacccggaccgagcgcccccuguccgccgggguguacaugggcaaccugagcucccagcagcucgaccagcggcgcgcgcugcugaacaugcucgggaugagcggcuccaaccagggcgcccgggccgggcgcgacggcgugguccgggugugggacgugaagaacgccgagcugcugaacaaccaguucgggacgaugccgagccucacccuggcgugccugaccaagcagggccaggucgaccucaacgacgccgugcaggcccugaccgaccuggggcucaucuacacggccaaguaccccaacaccuccgaccuggaccgccugacccagagccaccccauccucaacaugaucgacaccaagaaguccagccugaacaucagcggcuacaacuucucccugggcgccgcggugaaggccggggccugcaugcucgacggcgggaacaugcuggagacgaucaaggucagcccccagaccauggacggcauccugaaguccauccucaaggugaagaaggcccugggcauguucaucagcgacaccccgggggagcggaaccccuacgagaacauccuguacaagaucugccucuccggcgacggguggcccuacaucgccagccgcaccuccaucacgggccgggcgugggagaacaccguggucgaccuggagagcgacgagaagccccagaaggccggguccaacagcuccaacaagagccugcaguccgccggcuucaccgccggccucaccuacagccagcugaugacgcugaaggacgccaugcugcagcucgacccgaacgcgaagaccuggauggacaucgaggggcgccccgaggaccccguggagaucgcccuguaccagcccuccagcggcugcuacauccacuucuuccgggagccgaccgaccugaagcaguucaagcaggacgccaaguacucccacgggaucgacgugaccgaccucuucgccgcccagcccggccugacgagcgcggucaucgacgcccugccccgcaacauggugaucacgugccaggggagcgacgacauccgcaagcuccuggagucccagggccggaaggacaucaagcugaucgacaucgcccucagcaagaccgacucccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucagcgggggccucaacgccuccgugcugcgggccgugcugccccgggacauggucuuccgcaccagcacgccccggguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5098 - RNA, 1927 nt, Artificial Sequence
  mRNA product Design1 comprising derived and/or modified sequence from Lassa virus__AIT17361__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccuccgacgaccugcucgugcuggccgccgaccuggagaagcucaagagcaaggugacccggaccgagcgcccccuguccgccggggucuacaugggcaaccugagcucccagcagcucgaccagcggcgcgcgcugcugaacaugaucgggaugagcggcggcaaccagggggcccgggccggccgcgacgggguggugcggaucugggacgucaagaacgccgagcuccugaacaaccaguucggcacgaugccgucccugacccucgcgugccugaccaagcagggccagguggaccugaacgacgugguccaggcccucaccgaccuggggcugaucuacacggccaaguaccccaacaccagcgaccucgaccgccugacccagucccaccccauccugaacaugaucgacaccaagaaguccagccucaacaucagcggcuacaacuucagccugggggccgccgugaaggcgggcgccugcaugcuggacgggggcaacaugcucgagacgaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccaucguggaccucgaguccgacggcaagccccagaagaccaacaacaccaacagcaacaagucccugcagagcgcgggcuucgccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgucacggaccuguucgccgcccagcccgggcucaccuccgccgugaucgacacccugccccgcaacauggugaucacgugccagggcagcgaggacauccgccggcugcucgagucccagggccgcaaggacaucaagcugaucgacaucgcgcugagcaagaccgacagccggaaguacgagaacgccgucugggaccaguacaaggaccucugccacaugcacaccgggguggucguggagaagaagaagaagggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5099 - RNA, 1927 nt, Artificial Sequence
  mRNA product Design1 comprising derived and/or modified sequence from Lassa virus__AIT17365__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccaggccgggcgggacggcgugguccgcgugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgcgucccggaccagcaucaccggccgcgccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugaccgaccuguucgccgcgcagcccggccucaccagcgccgucaucgacgcccugccccggaacauggugaucacgugccagggcuccgacgacauccgcaagcuguucgagagccaggggcgcaaggacaucaagcucaucgacaucgcccugagcaagaccgacucccggaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgcgacauggucuuccggaccagcacgccccgcguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5100 - RNA, 1927 nt, Artificial Sequence
  mRNA product Design1 comprising derived and/or modified sequence from Lassa virus__AIT17371__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccaggccgggcgggacggcgugguccgcgugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgcgucccggaccagcaucaccggccgcgccugggagaacacgguggucgaccucgaguccgacgggaagccccagaaggccggcagcaacuccagcaacaagucccugcagagcgccggcuucaccgccgggcugaccuacucccagcucaugacccugaaggacgcgaugcugcagcuggacccgaacgccaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccgcgcagcccgggcucaccuccgccgucaucgacgcccugccccggaacauggugaucacgugccagggcagcgacgacauccgcaagcuguucgagagccagggccgcaaggacaucaagcucaucgacaucgcccuguccaagaccgacagccggaaguacgagaacgcggugugggaccaguacaaggaccugugccacaugcacaccgggaucgucguggagaagaagaagcgcggcgggaaggaggagaucacgccccacugcgcccucauggacugcaucauguucgacgccgccgucuccggcgggcugaacaccagcgugcugcgggccgugcucccgcgcgacauggucuuccggaccuccacgccccgcguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5101 - RNA, 1927 nt, Artificial Sequence
  mRNA product Design1 comprising derived and/or modified sequence from Lassa virus__AIT17379__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccagcgacgaccugcucauccuggccgccgaccuggagaagcucaagagcaaggugacccggaccgagcgcccccuguccgccgggguguacaugggcaaccugagcucccagcagcucgaccagcggcgcgcgcugcugaacaugaucgggaugagcuccggcaaccggggcgcccaggccgggcgcgacggcgucgugcgggugugggacgucaagaacgccgagcuccugaacaaccaguucgggacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacauggucgacaccaagaaguccagccucaacaucagcggcuacaacuucucccugggcgccgcggugaaggccggggccugcaugcuggacggcgggaacaugcucgagacgaucaaggugagcccccagaccauggacggcauccugaaguccauccugaaggucaagaaggcccucggcauguucaucagcgacaccccgggggagcggaaccccuacgagaacauccuguacaagaucugccuguccggcgacggguggcccuacaucgccagccgcaccuccaucacgggccgggcgugggagaacaccgugguggaccucgagagcgacgggaagccccagaaggccggcuccaacaacagcaacaagucccugcagagcgccggcuucgccgccgggcugaccuacucccagcucaugacccugaaggacgcgaugcugcagcuggacccgaacgccaagacguggauggacaucgagggccgccccgaggaccccgucgagaucgcccucuaccagcccagcuccgggugcuacauccacuucuuccgggagccgaccgaccugaagcaguucaagcaggacgccaaguacagccacggcaucgacgugaccgaccuguucgccgcgcagcccgggcucaccuccgccgugaucgacgcccugccccgcaacauggucaucacgugccagggcagcgacgacauccgcaagcugcucgagagccagggccggaaggacaucaagcugaucgacaucgcccuguccaagaccgacagccgcaaguacgagaacgcggugugggaccaguacaaggaccucugccacaugcacaccgggaucgucguggagaagaagaagcggggcgggaaggaggagaucacgccccacugcgcccugauggacugcaucauguucgacgccgccguguccggcgggcugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5102 - RNA, 1927 nt, Artificial Sequence
  mRNA product Design1 comprising derived and/or modified sequence from Lassa virus__AIT17381__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggcccgggccggccgcgacgggguggugcggaucugggacgucaagaacgccgagcuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccuccaacaccaacagcaacaagucccugcagagcgcgggcuucgccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgucacggaccuguucgccgcccagcccgggcucaccuccgccgugaucgacgcgcugccccgcaacauggugaucacgugccagggcagcgaggacauccgcaagcugcucgagagccagggccggaaggacaucaagcugaucgacaucgcccuguccaagaccgacagccgcaaguacgagaacgccgucugggaccaguacaaggaccucugccacaugcacaccgggguggucguggagaagaagaagaagggcgggaaggaggagaucaccccgcacugcgcccugauggacugcaucauguucgacgcggccguguccggcgggcugaacaccagcguccuccgggccgugcugccccgcgacaugguguuccggaccuccacgccccgcgucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5103 - RNA, 1927 nt, Artificial Sequence
  mRNA product Design1 comprising derived and/or modified sequence from Lassa virus__AIT17389__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcugaaguccacccagcagaaguccgugcuccgcgucgggacccugaccagcgacgaccugcucauccuggccgccgaccuggagaagcucaaguccaaggugacccggaccgagcgcccccugagcgccggcguguacauggggaaccuguccagccagcagcucgaccagcggcgcgcgcugcugaacaugaucggcauguccggcgggaaccagggcgcccggacggggaaggacggcgucgugcgcaucugggacgugaagaacgccgaccuccugaacaaccaguucgggaccaugccgagccugacccucgccugccugaccaagcagggccaggucgaccugaacgacguggugcaggcgcucacggaccugggccugaucuacaccgccaaguaccccaacaccuccgaccucgaccggcugacccagagccaccccauccugaacaugaucgacacguccaagagcagccucaacaucuccggguacaacuucagccugggcgccgccgucaaggccggggcgugcaugcuggacggcggcaacaugcucgagaccaucaaggugagcccccagaccauggacgggauccucaagagcauccugaaggugaagaagucccugggcauguucaucagcgacaccccgggggagcgcaaccccuacgagaacauccuguacaagaucugccuguccggcgacggguggcccuacaucgccagccggacguccaucaccggccgcgccugggagaacaccgucguggaccucgagagcgacggcaagccccagaaggccggguccaacaacagcaacaagucccugcagagcaccggcuucacggccgggcugaccuacucccagcucaugacccugaaggacgcgaugcugcagcuggacccgaacgccaagaccuggauggacaucgagggccggcccgaggaccccguggagaucgcccucuaccagcccagcuccgggugcuacauccacuucuuccgcgagccgacggaccugaagcaguucaagcaggacgccaaguacagccacggcaucgacgucaccgaccuguucgccgcgcagcccggccucaccuccgccgugaucgacacccugccccggaacauggugaucacgugccaggggagcgacgacauccgcaagcugcucgagagccagggccgcaaggacaucaagcugaucgacaucgcccuguccaagaccgacagccggaaguacgagaacgccgucugggaccaguacaaggaccucugccacaugcacaccgggguggucguggagaagaagaagcgcggcgggaaggaggagaucacgccccacugcgcccugauggacugcaucauguucgacgcggccguguccggcggccugaacgucagcgugcuccgggccgugcugccgcgcgacauggucuuccggaccuccacgccccgcguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5104 - RNA, 1927 nt, Artificial Sequence
  mRNA product Design1 comprising derived and/or modified sequence from Lassa virus__AIT17399__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacccugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcuggcccagagccaccccauccugaacaugaucgacaccaagaaguccagccucaacaucagcggcuacaacuucucccugggggccgccgucaaggccggcgcgugcaugcuggacgggggcaacaugcucgagaccaucaaggugacgccccagaccauggacggcauccucaagagcauccugaaggugaagaaggcccuggggauguucaucuccgagaccccgggcgagcgcaaccccuacgagaacauccuguacaagaucugccugagcggggacggcuggcccuacaucgccucccggaccagcaucaccgggcgcgccugggagaacacggucguggaccucgaguccgacggcaagccccagaaggccggcaacaacaacagcaacaagucccugcagagcgcgggguucaccgccggccugaccuacucccagcucaugacccugaaggacagcaugcugcagcuggacccgaacgccaagacguggauggacaucgaggggcggcccgaggaccccguggaggucgcccucuaccagcccuccagcggcugcuacauccacuucuuccgcgagccgaccgaccugaagcaguucaagcaggacgccaaguacucccacgggaucgacgugaccgaccuguucgcgacccagcccggccucacgagcgccgucaucgaggcccugccccggaacauggugaucacgugccagggcuccgacgacauccgcaagcugcucgagagccaggggcgcaaggacaucaagcugaucgacaucgcccugaacaagaccgacagccggaaguacgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaagacccucgcccugcgggcggugcugccgcgcgacaugguguuccggaccagcacccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5105 - RNA, 1927 nt, Artificial Sequence
  mRNA product Design1 comprising derived and/or modified sequence from Lassa virus__AIT17405__NP (opt1)
gggagaaagcuuaccaugagcguguccaaggaggucaagagcuuccuguggacccagucccuccgccgggagcugagcggcuacugcuccaacaucaagcuccagguggugaaggacgcccaggcccugcugcacgggcuggacuucagcgaggucuccaacgugcagcgccucaugcggaagcagaagcgcgacgacagcgaccugaagcggcugcgcgaccucaaccaggcggugaacaaccuggucgagcugaaguccacccagcagaaguccauccuccgggugggcacccugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcccaggggacccagccgggccgcgacggggugguccgggugugggacgugaagaaccccgaccuccugaacaaccaguucggcaccaugcccagccugacccucgcgugccugacgaagcaggggcaggucgaccugaacgacgccgugcucgcccugaccgaccugggccucaucuacaccgccaaguaccccaacuccagcgaccuggaccgccugucccagagccacccgauccucaacaugguggacaucaagaaguccagccugaacaucagcggcuacaacuucucccugggggcggccgucaaggccggcgccugcaugcucgacgggggcaacaugcuggagaccaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgccagccggaccuccaucguggggcgcgcgugggagaacacgaccguggaccuggagagcgacggcaagccccagaaggucggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgcgaaguacucccacggcaucgacgucgccgaccuguucccggcccagcccggccucaccagcgccgugaucgaggcccugccccggaacauggugcugacgugccaggggagcgacgacaucaagcgccuccuggacucccagggccgccgggacaucaagcugaucgacaucgcgcucagcaaggccgacucccgccgguucgagaacgccgucugggaccagugcaaggaccugugccacaugcacaccggggugguggucgagaagaagaagcgcggcgggaaggaggagaucacgccccacugcgcccugauggacugcaucauguacgacgccgcggugagcggcggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5106 - RNA, 1927 nt, Artificial Sequence
  mRNA product Design1 comprising derived and/or modified sequence from Lassa virus__AIT17409__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucaacaaggccgacucccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgccgcggucagcggcgggcucaacauccccgugcugcgggccgugcugccgcgggacauggucuuccgcaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5107 - RNA, 1927 nt, Artificial Sequence
  mRNA product Design1 comprising derived and/or modified sequence from Lassa virus__AIT17413__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacgcgcccggcgagcgcaaccccuacgagaacauccuguacaagaucugccucagcggggacggcuggccguacaucgccucccggaccagcaucgucgggcgcgccugggagaacaccaccguggaccuggaguccgacggcaagccccagaagaugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5108 - RNA, 1927 nt, Artificial Sequence
  mRNA product Design1 comprising derived and/or modified sequence from Lassa virus__AIT17421__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucagcggcgcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaucaagaaguccagccugaacaucuccggcuacaacuucagccugggcgccgccgugaaggccggggccugcaugcucgacggcgggaacaugcuggagaccaucaaggucacgccccagaccauggacggcauccugaaguccauccucaaggugaagcggagccugggcauguucguguccgacacccccggggagcgcaaccccuacgagaacauccuguacaagaucugccucagcggcgacggguggccguacaucgcgucccggaccagcaucgucggccgcgccugggagaacacgaccguggaccuggaguccgacgggaagccccagaagaugggcagcgccggcuccaacaagagccugcaguccgccggguuccccaccggccucaccuacagccagcugaugacgcugaaggacuccaugaugcagcuggaccccagcgccaagaccuggaucgacaucgaggggcggccggaggaccccguggagaucgcgcucuaccagcccauguccggcugcuacauccacuucuuccgcgagcccaccgaccugaagcaguucaagcaggacgccaaguacagccacgggaucgacgucgccgaccuguucccggcccagcccggccucaccagcgccgugaucgaggcgcugccccggaacaugguccugacgugccagggcuccgacgacaucaagcgccuccuggacagccaggggcgccgggacaucaagcugaucgacaucgcccucuccaaggccgacagccgccgguucgagaacgccgugugggaccagugcaaggaccugugccacaugcacaccggcguggucguggagaagaagaagcgcgggggcaaggaggagaucacgccccacugcgcccugauggacugcaucauguacgacgcggccguguccgggggccucaacaucccgguccugcgggccgugcugccccgcgacaugguguuccggaccagcucccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5109 - RNA, 1927 nt, Artificial Sequence
  mRNA product Design1 comprising derived and/or modified sequence from Lassa virus__AIT17425__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagaagucccuggggauguucgugagcgacacccccggcgagcggaaccccuacgagaacauccuguacaagaucugccucagcggggacggcuggccguacaucgcgucccgcaccagcaucgucgggcgggccugggagaacaccaucguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccgucgagaucgcgcucuaccagcccaugagcgggugcuacauccacuucuuccgggagcccaccgaccugaagcaguucaagcaggacgccaaguacucccacggcaucgacguggccgaccuguucccggcccagcccggccucacgagcgccgucaucgaggcgcugccccgcaacauggugcugaccugccaggggagcgacgacaucaagcggcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5110 - RNA, 1927 nt, Artificial Sequence
  mRNA product Design1 comprising derived and/or modified sequence from Lassa virus__AIT17429__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuacaacuucucccugggggccgccgugaaggccggcgcgugcaugcucgacgggggcaacaugcuggagaccaucaaggucacgccccagaccauggacggcauccucaagagcauccugaaggugaagcggucccuggggauguucgugagcgacgcccccggcgagcgcaaccccuacgagaacauccuguacaagaucugccucuccggggacggcuggccguacaucgccagccggaccuccaucgucgggcgcgccugggagaacaccacgguggaccuggagagcgacggcaagccccagaaggugggcaccgccggguccaacaagagccugcaguccgcgggcuuccccaccgggcucaccuacagccagcugaugacgcugaaggacuccaugaugcagcuggaccccagcgccaagaccuggaucgacaucgagggccggccggaggaccccgucgagaucgcccucuaccagcccauguccgggugcuacauccacuucuuccgcgagcccaccgaccugaagcaguucaagcaggacgccaaguacagccacggcaucgacguggccgaccuguucccggcgcagcccggccucaccuccgccgucaucgaggcccugccccggaacauggugcugacgugccaggggagcgacgacaucaagcgccuccuggacagccagggccgccgggacaucaagcugaucgacaucgcccucuccaaggccgacagccgccgguucgagaacgcggugugggaccagugcaaggaccugugccacaugcacaccggggucgugguggagaagaagaagcgcggcgggaaggaggagaucacgccccacugcgcccugauggacugcaucauguacgacgccgccgucuccggcggccucaacaucccggugcugcgggcggugcugccccgcgacauggucuuccggaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5111 - RNA, 1927 nt, Artificial Sequence
  mRNA product Design1 comprising derived and/or modified sequence from Lassa virus__AIT17431__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuucaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccgccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5112 - RNA, 1927 nt, Artificial Sequence
  mRNA product Design1 comprising derived and/or modified sequence from Lassa virus__AIT17439__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuucaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccgucagcgggugcuacauccacuucuuccgcgagcccacggaccugaagcaguucaagcaggacgccaaguacucccacggcaucgacguggccgaccuguucagcgcccagccgggccucaccagcgccgucaucgaggcgcugccccggaacauggugcugaccugccagggguccgacgacaucaagcgccuccuggacagccagggccgccgggacaucaagcugaucgacaucgcccucuccaaggccgacagccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucuccggcggccucaacauccccguguuccgggccgugcugccgcgcgacauggucuuccggaccagcucccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5113 - RNA, 1927 nt, Artificial Sequence
  mRNA product Design1 comprising derived and/or modified sequence from Lassa virus__AIT17443__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacgcgcccggcgagcgcaaccccuacgagaacauccuguacaagaucugccucagcggggacggcuggccguacaucgccucccggaccagcaucgucgggcgcgccugggagaacaccaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcgcugauggacugcaucauguacgacgccgccgucagcggcggccucaacaucccggugcugcgcgccgugcugccccgggacauggucuuccgcaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5114 - RNA, 1927 nt, Artificial Sequence
  mRNA product Design1 comprising derived and/or modified sequence from Lassa virus__AIT17447__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacgugaccgaccuguucccggcccagcccggccucaccuccgccgucaucgaggcccugccccgcaacauggugcugacgugccaggggagcgacgacaucaagcggcuccuggacagccagggccgccgcgacaucaagcugaucgacaucgcccucuccaaggcggacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgccgccgucuccggcggccucaacaucccggugcugcgcgcggugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5115 - RNA, 1927 nt, Artificial Sequence
  mRNA product Design1 comprising derived and/or modified sequence from Lassa virus__AIT17451__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacguggccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5116 - RNA, 1927 nt, Artificial Sequence
  mRNA product Design1 comprising derived and/or modified sequence from Lassa virus__AIT17455__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcuguccaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccagcgccgugaucgaggcgcugccccggaacauggugcugaccugccagggguccgacgacaucaagcgccuccuggacagccagggccgccgggacaucaagcugaucgacaucgcccucuccaaggccgacagccgccgguucgagaacgccgucugggaccagugcaaggaccugugccacaugcacaccggggugguggucgagaagaagaagcgcggcgggaaggaggagaucacgccccacugcgcccugauggacugcaucauguacgacgcggccguguccggcggccucaacaucccggugcugcgggccguccugccccgcgacaugguguuccggaccagcucccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5117 - RNA, 1927 nt, Artificial Sequence
  mRNA product Design1 comprising derived and/or modified sequence from Lassa virus__AIT17459__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccgucagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5118 - RNA, 1927 nt, Artificial Sequence
  mRNA product Design1 comprising derived and/or modified sequence from Lassa virus__AIT17463__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcacaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaguccacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaccaugguggacacgaagaaguccagccugaacaucagcggcuucaacuucucccugggcgccgccgugaaggccggggccugcaugcucgacggcgggaacaugcuggagaccaucaaggucacgccccagaccauggacggcauccucaagagcauccugaaggugaagaagucccugggcauguucgugagcgacacccccggggagcggaaccccuacgagaacauccuguacaagaucugccucuccggcgacggguggccguacaucgcgagccgcaccuccaucgucggccgggccugggagaacaccaucguggaccuggagaccgacgggaagccccagaaggugggcacggccggcagcucccgcagccugcaguccgccggguuccccaccggccucaccuacagccagcugaugacccugaaggacuccaugaugcagcuggaccccagcgccaagacguggaucgacaucgaggggcggccggaggaccccgucgagaucgcgcucuaccagcccauguccggcugcuacauccacuucuuccgcgagcccaccgaccugaagcaguucaagcaggacgccaaguacagccacgggaucgacguggccgaccuguucccggcccagcccggccucaccagcgccgucaucgaggcgcugccccggaacauggugcugaccugccagggcuccgacgacaucaagaagcuccuggacagccaggggcgccgcgacaucaagcugaucgacaucgcccucuccaaggccgacagccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgcggccgucuccgggggccucaacaucccggugcugcgggccgugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5119 - RNA, 1927 nt, Artificial Sequence
  mRNA product Design1 comprising derived and/or modified sequence from Lassa virus__AIT17467__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcacccaggggacccagccgggccgcgacgggguggugcgggucugggacgugaagaaccccgaccuccugaacaaccaguucggcaccaugcccucccugacgcucgcgugccugaccaagcagggccagguggaccugaacgacgccguccucgcccugaccgaccuggggcucaucuacaccgccaaguaccccaacagcuccgaccuggaccgccugagccagagccacccgauccucaacaugguggacacgaagaaguccagccugaacaucuccggcuacaacuucagccugggggcggccgugaaggccggcgccugcaugcucgacgggggcaacaugcuggagaccaucaaggucacgccccagaccauggacggcauccugaaguccauccucaaggugaagaagucccuggggauguucgugagcgacacccccggcgagcggaaccccuacgagaacauccuguacaagaucugccucagcggggacggcuggccguacaucgccucccgcaccagcaucgucgggcgggcgugggagaacaccaccguggaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacguggccgaccuguucccggcccagcccggccucaccagcgccgucaucgaggcccugccccgcaacauggugcugaccugccaggggagcgacgacaucaagcggcuccuggacucccagggccgccgcgacaucaagcugaucgacaucagccucuccaaggcggacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgccgucuccggcggccucaacaucccggugcugcgcgcggugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5120 - RNA, 1927 nt, Artificial Sequence
  mRNA product Design1 comprising derived and/or modified sequence from Lassa virus__AIT17471__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccacggggagcaacaagucccugcagagcgccggcuuccccaccgggcucaccuacucccagcugaugacccugaaggacagcaugaugcagcuggaccccuccgccaagacguggaucgacaucgagggccggccggaggaccccguggagaucgcccucuaccagcccaugagcgggugcuacauccacuucuuccgcgagcccaccgaccugaagcaguucaagcaggacgcgaaguacucccacggcaucgacgucgccgaccuguucccggcccagcccggccucaccagcgccgugaucgaggcccugccccggaacaugguccugaccugccaggggagcgacgacaucaagaagcuccuggacucccagggccgccgcgacaucaagcugaucgacaucgcgcucagcaaggccgacucccggaaguucgagaacguggugugggaccagugcaaggaccugugccacaugcacacgggggucgugguggagaagaagaagcgcggcgggaaggaggagaucacgccccacugcgcccugauggacugcaucauguacgacgccgccgucagcggcggccucaacaucccggugcugcgggcggugcugccccgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5121 - RNA, 1927 nt, Artificial Sequence
  mRNA product Design1 comprising derived and/or modified sequence from Lassa virus__AIT17475__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcgcccagcagcucgagcagcgccgggcgcugcuguccaugaucgggauggugggcggcgcccaggggacgcagccgggccgcgacggggugguccgggugugggacgugaagaaccccgaccuccugaacaaccaguucggcaccaugcccagccugacccucgccugccugaccaagcaggggcaggucgaccugaacgacacggugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccaucuccgggugcuacauccacuucuuccgcgagcccacggaccugaagcaguucaagcaggacgccaaguacagccacggcaucgacgucaccgaccuguucccggcccagcccggccucaccagcgccgugaucgaggcccugccccggaacauggugcugaccugccagggguccgacgacaucaagcgccuccuggacagccagggccgccgggacaucaagaucaucgacaucgcgcuguccaaggccgacagccgccgguucgagaacgccgucugggaccagugcaaggaccucugccacaugcacacgggggugguggucgagaagaagaagcgcggcgggaaggaggagaucacgccccacugcgcccugauggacugcaucauguacgacgccgcgguguccggcggccugaacaucccggugcuccgggccguccugccccgcgacaugguguuccggaccagcucccccaaggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5122 - RNA, 1927 nt, Artificial Sequence
  mRNA product Design1 comprising derived and/or modified sequence from Lassa virus__AIT17479__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccgggugggcacgcugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugucccagagccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccuccgccgugaucgaggcgcugccccggaacauggugcugaccugccaggggagcgacgacaucaagaagcuccuggacagccagggccgcaaggacaucaagcugaucgacaucgcccucuccaaggucgacagccgccgguucgagaacgccgugugggaccagugcaaggaccugugccacaugcacaccgggguggucguggagaagaagaagcgcggcgggaaggaggagaucacgccccacugcgcccugauggacugcaucauguacgacgccgcgguguccggcggccucaacaucccgguccugcgggccgugcugccccgcgacaugguguuccggaccagcucccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5123 - RNA, 1927 nt, Artificial Sequence
  mRNA product Design1 comprising derived and/or modified sequence from Lassa virus__AIT17491__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacgcugaccagcgacgaccugcucacccuggccgccgaccuggagaagcucaaguccaaggugauccgcaccgagcggccccugagcuccggcgucuacauggggaaccugagcacgcagcagcucgagcagcgccgggcccugcuguccaugaucggcauggugggcggggcgcgcggcacccagccggggcgggacggcgugguccgcgugugggacgugaagaaccccgaccuccugaacaaccaguucgggaccaugcccagccugacccucgccugccugacgaagcagggccaggucgaccugaacgacguggugcucgcccugaccgaccugggccucaucuacaccgccaaguaccccaacuccagcgaccuggaccggcugucccagagccacccgauccucaacauggucgacaccaagaaguccagccugaacaucagcggguacaacuucucccugggcgcggccgugaaggccggggccugcaugcucgacggcggcaacaugcuggagacgaucaaggugacgccccagaccauggacgggauccucaagagcauccugaaggucaagaagucccugggcauguucgugagcgacacccccggggagcgcaaccccuacgagaacauccuguacaagaucugccucuccggcgacggguggccguacaucgccagccggaccuccaucgugggccgcgcgugggagaacaccaccgucgaccuggagagcgacggcaagccccagaaggugggggccgccggcuccaacaagagccugcaguccgccggguuccccaccggccucacguacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccaccgaccugaagcaguucaagcaggacgccaaguacagccacggcaucgacgugacggaccuguucuccgcccagccggggcucaccagcgccgugaucgaggcccugccccggaacaugguccugaccugccagggcagcgacgacaucaagcgccuccuggacucccaggggcgccgggacaucaagcugaucgacaucgcgcucagcaaggccgacucccgccgguucgagaacgccgugugggaccagugcaaggaccugugccacaugcacaccggcguggucguggagaagaagaagcgcgggggcaaggaggagaucacgccccacugcgcccugauggacugcaucauguacgacgccgcggugagcggcgggcucaacauccccguccugcgggccgugcugccgcgcgacaugguguuccggaccuccagccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5124 - RNA, 1927 nt, Artificial Sequence
  mRNA product Design1 comprising derived and/or modified sequence from Lassa virus__AIT17495__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcagagcgcccagccggggcgcgacggcguggugcgggucugggacgugaagaaccccgaccuccugaacaaccaguucgggaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuucaacuucagccugggcgccgccgugaaggccggggcgugcaugcucgacggcgggaacaugcuggagaccaucaaggucacgccccagaccauggacggcauccugaaguccauccucaaggugaagcggagccugggcauguucguguccgacgcccccggggagcgcaaccccuacgagaacauccuguacaagaucugccucagcggcgacggguggccguacaucgccucccggaccagcaucgucggccgcgccugggagaacaccacgguggaccuggaguccgacgggaagccccagaaggugggcaccgccggcagcaacaagucccugcagagcgcgggguuccccaccggccucaccuacucccagcugaugacgcugaaggacagcaugaugcagcuggaccccuccgccaagaccuggaucgacaucgaggggcggccggaggaccccgucgagaucgcccucuaccagcccaugagcggcugcuacauccacuucuuccgcgagcccaccgaccugaagcaguucaagcaggacgccaaguacucccacgggaucgacguggccgaccuguucccggcgcagcccggccucaccagcgccgucaucgaggcccugccccggaacauggugcugacgugccagggcagcgacgacaucaagaagcuccuggacucccaggggcgccgcgacaucaagcugaucgacaucgcccucagcaaggccgacucccggcgcuucgagaacgcggugugggaccagugcaaggaccugugccacaugcacaccggcgucgugguggagaagaagaagcgcgggggcaaggaggagaucacgccccacugcgcccugauggacugcaucauguacgacgccgccgucagcgggggccucaacaucccggugcugcgggcggugcugccccgggacauggucuuccgcaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5125 - RNA, 1927 nt, Artificial Sequence
  mRNA product Design1 comprising derived and/or modified sequence from Lassa virus__AIT17499__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaucaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcgccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacgugaagcgccuccuggacucccagggccgccgggacaucaagcugaucgacaucgcccucagcaaggccgacucccgccgguucgagaacgccgucugggaccagugcaaggaccugugccacaugcacaccggggugguggucgagaagaagaagcgcggcgggaaggaggagaucacgccccacugcgcgcugauggacugcaucauguacgacgccgccgugagcggcggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5126 - RNA, 1927 nt, Artificial Sequence
  mRNA product Design1 comprising derived and/or modified sequence from Lassa virus__AIT17503__NP (opt1)
gggagaaagcuuaccaugagcuccagcaaggaggugaaguccuuccuguggacccagagccuccgccgggagcuguccggcuacugcagcuccaucaagcugcaggucgugaaggacgcccaggcccuccugcacgggcuggacuucagcgagguguccaacguccagcgccucaugcggaagcagaagcgcgacgacagcgaccugaagcggcugcgcgaccucaaccaggcggugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugagccagucccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacgagcgccgucaucgaggcgcugccccgcaacauggugcugaccugccagggguccgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5127 - RNA, 1927 nt, Artificial Sequence
  mRNA product Design1 comprising derived and/or modified sequence from Lassa virus__AIT17507__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccaucgacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccgucgagaucgcgcuguaccagcccauguccgggugcuacauccacuucuuccgggagcccacggaccugaagcaguucaagcaggacgccaaguacagccacggcaucgacguggccgaccucuucccggcccagcccggccugaccuccgccgucaucgaggcgcugccccgcaacauggugcugaccugccaggggagcgacgacaucaagcggcuccuggacagccagggccgccgcgacaucaagcucaucgacaucgcccuguccaagguggacagccggcgcuucgagaacgccgucugggaccagugcaaggaccugugccacaugcacaccggggugguggucgagaagaagaagcggggcgggaaggaggagaucacgccccacugcgcccucauggacugcaucauguacgacgccgcgguguccggcggccugaacaucccggugcugcgcgccguccucccccgggacaugguguuccgcaccagcucccccaaggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5128 - RNA, 1927 nt, Artificial Sequence
  mRNA product Design1 comprising derived and/or modified sequence from Lassa virus__AIT17511__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccaucgacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaaggccgacagccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgccgcggucuccggcgggcucaacauccccgugcugcgggccgugcugccgcgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5129 - RNA, 1927 nt, Artificial Sequence
  mRNA product Design1 comprising derived and/or modified sequence from Lassa virus__AIT17515__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcgccgccgggagcuccaagagccugcaguccgccggcuuccccaccgggcucacguacagccagcugaugacccugaaggacuccaugaugcagcuggaccccagcgcgaagaccuggaucgacaucgagggccggccggaggaccccgucgagaucgcccucuaccagcccguguccgggugcuacauccacuucuuccgcgagcccaccgaccugaagcaguucaagcaggacgccaaguacagccacggcaucgacgucgccgaccuguucccggcccagcccggccucacgagcgcggugaucgaggcccugccccggaacauggugcugaccugccagggguccgacgacaucaagcgccuccuggacagccagggccgccgggacaucaagcugaucgacaucgcccucuccaaggccgacagccgccgguucgagaacgccgucugggaccagugcaaggaccugugccacaugcacaccggggugguggucgagaagaagaagcgcggcgggaaggaggagaucacgccccacugcgcgcugauggacugcaucauguacgacgccgccguguccggcggccucaacaucccggugcugcgggccguccugccccgcgacaugguguuccggaccagcucccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5130 - RNA, 1927 nt, Artificial Sequence
  mRNA product Design1 comprising derived and/or modified sequence from Lassa virus__AIT17519__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuucaacuucucccugggggccgccgugaaggccggcgcgugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgccagccggaccuccaucgucgggcgcgccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgcgaagaccuggaucgacaucgagggccggccggaggaccccgucgagaucgcccucuaccagcccauguccgggugcuacauccacuucuuccgcgagcccaccgaccugaagcaguucaagcaggacgccaaguacagccacggcaucgacguggccgaccuguucccggcccagcccggccucacguccgcggucaucgaggcccugccccggaacauggugcugaccugccaggggagcgacgacaucaagcgccuccuggacagccagggccgccgggacaucaagcugaucgacaucgcccucuccaaggccgacagccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucuccggcggccucaacaucccggugcugcgggccgugcugccccgcgacauggucuuccggaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5131 - RNA, 1927 nt, Artificial Sequence
  mRNA product Design1 comprising derived and/or modified sequence from Lassa virus__AIT17525__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacccugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccggcugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcgcagccuggggauguucgucuccgacacccccggcgagcggaaccccuacgagaacauccuguacaagaucugccucagcggggacggcuggccguacaucgcgucccgcaccagcaucguggggcgggccugggagaacaccaccguggaccuggaguccgacggcaagccccagaaggucggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccacggaccugaagcaguucaagcaggacgccaaguacucccacggcaucgacgucgccgaccuguucccgacccagcccggccucaccagcgccgugaucgaggcccugccccgcaacauggugcugaccugccaggggagcgacgacaucaagcgccuccuggacucccagggccggcgcgacaucaagcugaucgacaucgcgcucagcaaggccgacucccggaaguucgagaacgccgucugggaccagugcaaggaccugugccacaugcacacgggggugguggucgagaagaagaagcgcggcgggaaggaggagaucacgccccacugcgcccugauggacugcaucauguacgacgccgcggugagcggcggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5132 - RNA, 1927 nt, Artificial Sequence
  mRNA product Design1 comprising derived and/or modified sequence from Lassa virus__AIT17533__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgaggugaacaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcacccaggggacccagccgggccgcgacggggucgugcgggugugggacgucaagaaccccgaccuccugaacaaccaguucggcaccaugcccucccugacgcucgccugccugaccaagcagggccagguggaccugaacgacgccgugcucgcccugaccgaccuggggcucaucuacaccgcgaaguaccccaacagcuccgaccuggaccgccugagccagucccacccgauccucaacauggucgacacgaagaaguccagccugaacaucagcggcuacaacuucagccugggggccgccgugaaggccggcgccugcaugcucgacgggggcaacaugcuggagaccaucaaggugacgccccagaccauggacggcauccugaaguccauccucaaggucaagcggagccuggggauguucguguccgacacccccggcgagcgcaaccccuacgagaacauccuguacaagaucugccucagcggggacggcuggccguacaucgcgucccggaccagcaucguggggcgcgccugggagaacaccaccgucgaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccggccggaggaccccguggagaucgcgcucuaccagcccaugagcgggugcuacauccacuucuuccgcgagcccaccgaccugaagcaguucaagcaggacgccaaguacucccacggcaucgacgucgccgaccuguucccggcccagcccggccucaccagcgccgugaucgaggcgcugccccggaacaugguccugaccugccagggguccgacgacaucaagaagcuccuggacagccagggccgccgcgacaucaagcugaucgacaucagccucuccaagaucgacagccggaaguucgagaacgccgugugggaccagugcaaggaccugugccacaugcacacggggguggucguggagaagaagaagcgcggcgggaaggaggagaucacgccccacugcgcccugauggacugcaucauguucgacgccgccguguccggcggccucaacaucccgguccugcgggcggugcugccccgcgacaugguguuccggaccagcucccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5133 - RNA, 1927 nt, Artificial Sequence
  mRNA product Design1 comprising derived and/or modified sequence from Lassa virus__AIT17539__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacgcugaccagcgacgaccugcucauccuggccgccgaccuggagaagcucaaguccaaggugauccgcaccgagcggccccugagcuccggcgucuacauggggaaccugagcacccagcagcucgagcagcgcaaggcccugcuguccaugaucggcauggugggcggggcgcagggcacgcagccggggcgggacggcgugguccgcgugugggacgugaagaaccccgaccuccugaacaaccaguucgggaccaugcccagccugacccucgccugccugaccaagcagggccaggucgaccugaacgacgccgugcucgcccugacggaccugggccucaucuacaccgcgaaguaccccaacuccagcgaccuggaccggcugucccagagccacccgauccucaacaugguggacaccaagaaguccagccugaacaucagcggguacaacuucucccugggcgccgccgucaaggccggggccugcaugcucgacggcggcaacaugcuggagaccaucaaggugacgccccagaccauggacgggauccucaagagcauccugaaggugaagcgcucccugggcauguucgucagcgacacccccggggagcggaaccccuacgagaacauccuguacaagaucugccucuccggcgacggguggccguacaucgcgagccgcaccuccaucgugggccgggccugggagaacacgaccguggaccuggagagcgacggcaagccccagaaggucggguccgccggcagcaacaagucccugcagagcgccggguuccccaccggccucaccuacucccagcugaugacgcugaaggacagcaugaugcagcuggaccccuccgccaagaccuggaucgacaucgaggggcgcccggaggaccccguggagaucgcgcucuaccagcccaugagcggcugcuacauccacuucuuccgggagcccaccgaccugaagcaguucaagcaggacgccaaguacucccacggcaucgacgucaccgaccuguucagcgcccagccggggcucacgagcgccgugaucgaggcccugccccgcaacauggugcugaccugccagggcuccgacgacaucaagaagcuccuggacagccaggggcggcgcgacaucaagcugaucgacaucucccucggcaaggcggacagccgccgguucgagaacgccgucugggaccagugcaaggaccugugccacaugcacaccggggugguggucgagaagaagaagcgcggcggcaaggaggagaucacgccccacugcgcccugauggacugcaucauguucgacgccgccguguccgggggccucaacauccccauccugcgggcggugcugccgcgcgacauggucuuccggaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5134 - RNA, 1927 nt, Artificial Sequence
  mRNA product Design1 comprising derived and/or modified sequence from Lassa virus__AIT17541__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugagcuccgacgaccugcucacccuggccgccgaccuggagaagcucaagagcaaggugauccgcaccgagcggccccuguccagcggcgucuacauggggaaccuguccagccagcagcucgaccagcgccgggcccugcugaacaugaucggcaugaccuccgaccgccagggcgcgagcacggggcgggacggcaucgugcgcgugugggacgucaagaacgccgagcuccugaacaaccaguucgggaccgugccgucccugacccucgccugccugaccaagcagggccagguggaccugaacgacgccguccaggcgcucacggaccuggggcugaucuacaccgccaaguaccccaacagcagcgaccucgaccggcugucccagagccaccccauccugaacaugaucgacaccaagaaguccagccucaacaucuccggcuacaacuucagccugggcgccgccgugaaggccggggcgugcaugcuggacggcgggaacaugcucgagaccaucaaggugagcccccagacgauggacggcauccucaagagcauccugaaggucaagcgcucccugggcauguucgugagcgacaucccgggggagcggaaccccuacgagaacauccuguacaagaucugccuguccggcgacggguggcccuacaucgccagccgcaccuccaucaccggccgggccugggagaacaccaucguggaccucgagagcgacuccaagccccagaagccggggaacagcggcuccaaccgcagccugcaguccgccggcuuccccgccgggcugacguacagccagcucaugacccugaaggacagcaugcugcagcuggaccccaacgcgaagaccuggauggacaucgagggccggcccgacgacccggucgagaucgcccucuaccagcccuccagcgggugcuacauccacuucuuccgcgagcccaccgaccugaagcaguucaagcaggacgccaaguacucccacggcaucgacgugggggaccuguucgccgcccagcccggccucacgagcgcggugaucgaggcccugccgcgcaacauggucaucacgugccagggcuccgaggacaucaagaagcugcucgagagccaggggcggaaggacaucaagcugguggacaucuccaugagcaagcccgacucccgcaaguucgagaacgccgucugggaccaguacaaggaccugugccacaugcacaccggcaucgugguggagaagaagaagcgcgggggcaaggaggagaucacgccccacugcgcccucauggacugcaucauguucgacgccgcggucgucgggggccuggacgcccggauccugcgggccgugcucccccgcgacaugguguuccggaccagcaccccgaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5135 - RNA, 1927 nt, Artificial Sequence
  mRNA product Design1 comprising derived and/or modified sequence from Lassa virus__AIT17545__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccgggugggcacgcugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugucccagagccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgcgagccgcaccuccaucguggggcgggccugggagaacaccaccguggaccuggagagcgacggcaagccccagaaggucggcaucgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccguggagaucgcgcucuaccagcccauguccgggugcuacauccacuucuuccgggagcccaccgaccugaagcaguucaagcaggacgccaaguacagccacggcaucgacgucgccgaccuguucuccgcccagccgggccucacgagcgccgugaucgaggcgcugccccgcaacauggugcugaccugccaggggagcgacgacaucaagcggcuccuggacucccagggccgccgcgacaucaagcugaucgacaucgcccucagcaaggccgacucccggaaguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucgacauccccgugcugcgggccguccugccgcgcgacaugguguuccggaccuccagccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5136 - RNA, 1927 nt, Artificial Sequence
  mRNA product Design1 comprising derived and/or modified sequence from Lassa virus__AIT17549__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgucgugcucgcccugaccgaccuggggcucaucuacaccgccaaguaccccaacuccagcgaccuggaccgccugucccagagccacccgauccucaacaugguggacaccaagaaguccagccugaacaucagcggcuacaacuucucccugggggcggccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgccagccgcaccuccaucguggggcgggcgugggagaacaccaccguggaccuggagagcgacggcaagccccagaaggucggcaccgugggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcccucuaccagcccauguccgggugcuacauccacuucuuccgggagcccacggaccugaagcaguucaagcaggacgccaaguacagccacggcaucgacguggcggaccuguucccggcccagcccggccucaccuccgccgugaucgaggcccugccccgcaacaugguccugaccugccaggggagcgacgacaucaagaagcuccuggacagccagggccggcgcgacaucaagcugaucgacaucgcccucuccaaggcggacagccgcaaguucgagaacgccgugugggaccagugcaaggaccugugccacaugcacaccgggguggucguggagaagaagaagcggggcgggaaggaggagaucacgccccacugcgcccugauggacugcaucauguacgacgccgccguguccggcggccucaacaucccgguccugcgcgcggugcugccccgggacaugguguuccgcaccagcucccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5137 - RNA, 1927 nt, Artificial Sequence
  mRNA product Design1 comprising derived and/or modified sequence from Lassa virus__AIT17553__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccaugagcgggugcuacauccacuucuuccgcgagcccacggaccugaagcaguucaagcaggacgccaaguacucccacggcaucgacgucgccgaccuguucccggcccagcccggccucaccagcgccgugaucgaggcgcugccccggaacaugguccugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcccugauggacugcaucauguacgacgcggccgugagcggcggccucaacaucccgguccugcgcgccgugcugccccgggacaugguguuccgcaccuccagccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5138 - RNA, 1927 nt, Artificial Sequence
  mRNA product Design1 comprising derived and/or modified sequence from Lassa virus__AIT17561__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccaucgacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgucggguccaacaagagccugcaguccgccggcuuccccacggggcucaccuacagccagcugaugacccugaaggacuccaugaugcagcuggaccccagcgccaagaccuggaucgacaucgagggccgcccggaggaccccguggagaucgcccucuaccagcccauguccgggugcuacauccacuucuuccgggagcccacggaccugaagcaguucaagcaggacgcgaaguacagccacggcaucgacgucgccgaccuguucccggcccagcccggccucaccuccgccgugaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgucugggaccagugcaaggaccugugccacaugcacaccggggugguggucgagaagaagcggcgcggcgggaaggaggagaucacgccccacugcgcccugauggacugcaucauguacgacgccgcgguguccggcggccucaacaucccggugcugcgggccguccugccccgcgacaugguguuccggaccagcucccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5139 - RNA, 1927 nt, Artificial Sequence
  mRNA product Design1 comprising derived and/or modified sequence from Lassa virus__AIT17565__NP (opt1)
gggagaaagcuuaccaugagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaaggccgacucccgcaaguucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5140 - RNA, 1927 nt, Artificial Sequence
  mRNA product Design1 comprising derived and/or modified sequence from Lassa virus__AIT17569__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacguggccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaaccugccggugcugcgcgccgugcucccccgggacauggucuuccgcaccagcucccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5141 - RNA, 1927 nt, Artificial Sequence
  mRNA product Design1 comprising derived and/or modified sequence from Lassa virus__AIT17573__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacaucgccgaccuguucccggcccagcccggccucaccuccgccgugaucgaggcgcugccccgcaacaugguccugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgcggccguguccggcggccucaacaucccgguccugcgcgccgugcugccccgggacaugguguuccgcaccagcucccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5142 - RNA, 1927 nt, Artificial Sequence
  mRNA product Design1 comprising derived and/or modified sequence from Lassa virus__AIT17577__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgccgggcgcgccugggagaacaccaccgucgaccuggaguccgacggcaagccccagaaggugggcgccgccgggagcaacaagucccugcagagcgcgggcuuccccaccgggcucacguacucccagcugaugacccugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcgcagcccggccucacgagcgccgugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgcggugugggaccagugccgcgaccugugccacaugcacaccgggguggucguggagaagaagaagcggggcgggaaggaggagaucacgccccacugcgcccugauggacugcaucauguacgacgccgccgugagcggcggccucaacaucccgguccugcgcgcggugcugccccgggacaugguguuccgcaccuccagccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5143 - RNA, 1927 nt, Artificial Sequence
  mRNA product Design1 comprising derived and/or modified sequence from Lassa virus__AIT17581__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcgcccagcagcucgagcagcgccggacgcugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacguggugcucgcccugaccgaccugggccucaucuacaccgccaaguaccccaacagcuccgaccuggaccgccugagccagagccacccgauccucuccauggucgacaccaagaaguccagccugaacaucagcggcuacaacuucucccugggggcggccgugaaggccggcgccugcaugcucgacgggggcaacaugcuggagacgaucaaggugacgccccagaccauggacggcauccucaagagcauccugaaggucaagaagucccuggggauguucgugagcgacacccccggcgagcggaaccccuacgagaacauccuguacaagaucugccucuccggggacggcuggccguacaucgccagccgcaccuccaucguggggcgggcgugggagaacaccaccgucgaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcccucuaccagcccauguccgggugcuacauccacuucuuccgggagcccacggaccugaagcaguucaagcaggacgcgaaguacagccacggcaucgacgugaccgaccuguucccggcccagcccggccucaccagcgccgugaucgaggcccugccccgcaacaugguccugaccugccagggguccgacgacaucaagcggcuccuggacagccagggccgccgcgacaucaagcugaucgacaucgcccucuccaaggcggacagccggcgcuucgagaacgccgugugggaccagugcaaggaccugugccacaugcacacggggguggucguggagaagaagaagcggggcgggaaggaggagaucacgccccacugcgcccugauggacugcaucauguacgacgccgccguguccggcggccucaacaucccgguccugcgcgcggugcugccccgggacaugguguuccgcaccagcucccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5144 - RNA, 1927 nt, Artificial Sequence
  mRNA product Design1 comprising derived and/or modified sequence from Lassa virus__AIT17589__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuacaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccaccgggagcaacaagucccugcagagcgccggcuuccccacggggcucaccuacucccagcugaugacccugaaggacagcaugaugcagcuggaccccuccgccaagaccuggaucgacaucgagggccggccggaggaccccgucgagaucgcgcucuaccagcccaugagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagaagcuccuggacucccagggccgccgcgacaucaagcugaucgacaucgcccucagcaaggccgacucccggaaguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5145 - RNA, 1927 nt, Artificial Sequence
  mRNA product Design1 comprising derived and/or modified sequence from Lassa virus__AIT17593__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacggcgaccugaagcggcugcgcgaccucaaccaggccgugaacaaccugguggagcugaaguccacccagcagaaguccauccuccgggucgggacgcugaccagcgacgaccugcucacccuggccgccgaccuggagaagcucaagagcaaggugauccgcaccgagcggccccuguccagcggcguguacauggggaaccuguccagccagcagcucgagcagcgccgggcccugcugaacaugaucggcauggucggcggggcgcagggcacgcagccggggcgcgacggcguggugcgggucugggacgugaagaaccccgaccuccugaacaaccaguucgggaccaugcccucccugacccucgccugccugaccaagcagggccagguggaccugaacgacgccguccucgcccugacggaccugggccucaucuacaccgcgaaguaccccaacagcuccgaccuggaccgccugagccagagccacccgauccucaacaugguggacaccaagaaguccagccugaacaucuccggguacaacuucagccugggcgccgccgugaaggccggggccugcaugcucgacggcggcaacaugcuggagaccaucaaggucacgccccagaccauggacgggauccugaaguccauccucaaggugaagcggagccugggcauguucguguccgacacccccggggagcgcaaccccuacgagaacauccuguacaagaucugccucagcggcgacggguggccguacaucgcgucccggaccagcaucgucggccgcgccugggagaacacgaccguggaccuggaguccgacggcaagccccagaaggugggggccgccggcagcaccaagucccugcagagcgccggguuccccaccggccucacguacucccagcugaugacccugaaggacagcaugaugcagcuggaccccuccgcgaagaccuggaucgacaucgaggggcggccggaggaccccgucgagaucgcccucuaccagcccaugagcggcugcuacauccacuucuuccgcgagcccaccgaccugaagcaguucaagcaggacgccaaguacucccacggcaucgacguggccgaccuguucccggcccagcccgggcucacgagcgcggucaucgaggcccugccccggaacauggugcugaccugccagggcagcgacgacaucaagcgccuccuggacucccaggggcgccgggacaucaagcugaucgacaucgcccucagcaagguggacucccgccgguucgagaacgccgucugggaccagugcaaggaccugugccacaugcacaccggcgugguggucgagaagaagaagcgcgggggcaaggaggagaucacgccccacugcgcccugauggacugcaucauguacgacgcggccgugagcggcgggcucaacaucccggugcugcgggccguccugccccgcgacaugguguuccggaccuccagccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5146 - RNA, 1927 nt, Artificial Sequence
  mRNA product Design1 comprising derived and/or modified sequence from Lassa virus__AIT17605__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagagccacccgauccucaacauggucgacaccaagaaguccagccugaacaucuccggcuacaacuucagccugggggccgccgugaaggccggcgcgugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggccugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgcgaagaccuggaucgacaucgagggccgcccggaggaccccguggagaucgcccucuaccagcccaugagcgggugcuacauccacuucuuccgggagcccacggaccugaagcaguucaagcaggacgccaaguacucccacggcaucgacgucgccgaccuguucagcgcccagccgggccucaccagcgcggugaucgaggcccugccccgcaacaugguccugaccugccagggguccgacgacaucaagcggcuccuggacagccagggccgccgcgacaucaagcugaucgacaucgcccucuccaaggccgacagccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccguguccggcggccucaacauccccguccugcgcgccgugcugccgcgggacaugguguuccgcaccagcucccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5147 - RNA, 1927 nt, Artificial Sequence
  mRNA product Design1 comprising derived and/or modified sequence from Lassa virus__AIT17609__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagagccacccgauccucaacauggucgacaccaagaaguccagccugaacaucuccggcuacaacuucagccugggggccgccgugaaggccggcgcgugcaugcucgacgggggcaacaugcuggagacgaucaaggugacgccccagaccauggacggcauccugaaguccauccucaaggucaagcggagccuggggauguucguguccgacacccccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcgccgccgggagcaacaagucccugcagagcgcgggcuuccccaccgggcucacguacucccagcugaugacccugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcgcagcccggccucacgagcgccgugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgcggugugggaccagugcaaggaccugugccacaugcacaccgggguggucguggagaagaagaagcgcggcgggaaggaggagaucacgccccacugcgcccugauggacugcaucauguacgacgccgccgugagcggcggccucaacaucccgguccugcgggcggugcugccccgcgacaugguguuccggaccuccagccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5148 - RNA, 1927 nt, Artificial Sequence
  mRNA product Design1 comprising derived and/or modified sequence from Lassa virus__AIT17613__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccgucgagaucgcgcucuaccagcccauguccgggugcuacauccacuucuuccgcgagcccacggaccugaagcaguucaagcaggacgccaaguacagccacggcaucgacguggccgaccuguucccggcccagcccggccucaccuccgccgucaucgaggcgcugccccggaacauggugcugaccugccaggggagcgacgacaucaagcgccuccuggacagccagggccgccgggacaucaagcugaucgacaucgcccucuccaagaccgacagccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucuccggcggccucaacaucccggugcugcgggccgugcugccccgcgacauggucuuccggaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5149 - RNA, 1927 nt, Artificial Sequence
  mRNA product Design1 comprising derived and/or modified sequence from Lassa virus__AIT17617__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuucaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5150 - RNA, 1927 nt, Artificial Sequence
  mRNA product Design1 comprising derived and/or modified sequence from Lassa virus__AIT17621__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugaccaacguccagcgccucaugcggaagcagaagcgcgacgacagcgaccugaagcggcugcgcgaccucaaccaggccgugaacaaccugguggagcugaaguccacgcagcagaaguccauccuccgggucggcacccugaccagcgacgaccugcucacccuggccgccgaccuggagaagcucaagagcaaggugauccgcacggagcggccccuguccagcgggguguacaugggcaaccuguccacccagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacgcucgccugccugaccaagcagggccagguggaccugaacgacgccguccucgcccugaccgaccuggggcucaucuacaccgcgaaguaccccaacuccagcgaccuggaccgccugucccagagccacccgauccucaacaugguggacacgaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaucgccggguccaacaagagccugcaguccgccggcuuccccacggggcucaccuacagccagcugaugacccugaaggacuccaugaugcagcuggaccccagcgccaagaccuggaucgacaucgagggccggccggaggaccccgucgagaucgcgcucuaccagcccauguccgggugcuacauccacuucuuccgcgagcccacggaccugaagcaguucaagcaggacgccaaguacagccacggcaucgacguggccgaccuguucccggcccagcccggccucaccuccgccgucaucgaggcgcugccccggaacauggugcugaccugccaggggagcgacgacaucaagcgccuccuggacagccagggccgccgggacaucaagcugaucgacaucgcccucuccaaggccgacagccgcaaguucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5151 - RNA, 1927 nt, Artificial Sequence
  mRNA product Design1 comprising derived and/or modified sequence from Lassa virus__AIT17625__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacgcugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccggcugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcgcagccuggggauguucgucuccgacacccccggcgagcggaaccccuacgagaacauccuguacaagaucugccucagcggggacggcuggccguacaucgcgucccgcaccagcaucguggggcgggccugggagaacaccaccguggaccuggaguccgacggcaagccccagaaggucggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccacggaccugaagcaguucaagcaggacgccaaguacucccacggcaucgacgucgccgaccuguucccggcccagcccggccucaccagcgccgugaucgaggcgcugccccgcaacauggugcugaccugccaggggagcgacgacaucaagcgccuccuggacucccagggccggcgcgacaucaagcugaucgacaucgcccucagcaaggccgacucccggaaguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5152 - RNA, 1927 nt, Artificial Sequence
  mRNA product Design1 comprising derived and/or modified sequence from Lassa virus__AIT17627__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcucccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugagccagucccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacacgaccguggaccuggagagcgacggcaagccccagaaggugggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccgucgagaucgcgcucuaccagcccaugagcgggugcuacauccacuucuuccgcgagcccaccgaccugaagcaguucaagcaggacgccaaguacagccacggcaucgacguggccgaccuguucccggcccagcccggccucaccuccgccgucaucgaggcgcugccccggaacauggugcugacgugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5153 - RNA, 1927 nt, Artificial Sequence
  mRNA product Design1 comprising derived and/or modified sequence from Lassa virus__AIT17631__NP (opt1)
gggagaaagcuuaccaugagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccgggguggucguggagaagaagaagcgcggcgggaaggaggagaucacgccccacugcgcgcugauggacugcaucauguacgacgccgccgugagcggcggccucaacaucccgguccugcgggccgugcugccccgcgacaugguguuccggaccuccagccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5154 - RNA, 1927 nt, Artificial Sequence
  mRNA product Design1 comprising derived and/or modified sequence from Lassa virus__AIT17635__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacaacgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugaacacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacucccagggccgccgcgacaucaagcugaucgacaucgcccucagcaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5155 - RNA, 1927 nt, Artificial Sequence
  mRNA product Design1 comprising derived and/or modified sequence from Lassa virus__AIT17639__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaucaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacacgaccguggaccuggagagcgacggcaagccccagaaggugggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccgucgagaucgcgcucuaccagcccaugagcgggugcuacauccacuucuuccgcgagcccaccgaccugaagcaguucaagcaggacgccaaguacucccacggcaucgacguggccgaccuguucccggcccagcccggccucaccagcgccgucaucgaggcgcugccccggaacauggugcugacgugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5156 - RNA, 1927 nt, Artificial Sequence
  mRNA product Design1 comprising derived and/or modified sequence from Lassa virus__AIT17643__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuacaacuucucccugggggccgccgugaaggccggcgcgugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgccagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgcgaagaccuggaucgacaucgagggccgcccggaggaccccgucgagaucgcccucuaccagcccauguccgggugcuacauccacuucuuccgggagcccaccgaccugaagcaguucaagcaggacgccaaguacagccacggcaucgacguggccgaccuguucccggcccagcccggccucacguccgcggucaucgaggcccugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcgcugauggacugcaucauguacgacgccgccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5157 - RNA, 1927 nt, Artificial Sequence
  mRNA product Design1 comprising derived and/or modified sequence from Lassa virus__AIT17651__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcgcccagcagcucgagcagcgccgggcgcugcugaacaugaucgggauggugggcggcgcccaggggacgcagccgggccgcgacggggugguccgggugugggacgugaagaaccccgaccuccugaacaaccaguucggcaccaugcccucccugacccucgccugccugaccaagcaggggcaggucgaccugaacgacguggugcucgcccugacggaccugggccucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagaccaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgcgucccgcaccagcaucguggggcgggccugggagaacacgaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccgucgagaucgcgcucuaccagcccaugagcgggugcuacauccacuucuuccgggagcccaccgaccugaagcaguucaagcaggacgccaaguacucccacggcaucgacgugacggaccuguucagcgcccagccgggccucaccagcgccgugaucgaggcccugccccgcaacaugguccugaccugccagggguccgacgacaucaagcggcuccuggacagccagggccgccgcgacaucaagcugaucgacaucgcgcucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgccgcgguguccggcggccucaacauccccguccugcgcgccgugcugccgcgggacaugguguuccgcaccagcucccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5158 - RNA, 1927 nt, Artificial Sequence
  mRNA product Design1 comprising derived and/or modified sequence from Lassa virus__AIT17655__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagaagccccuguccagcgggguguacaugggcaaccuguccacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccggcugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccggccggaggaccccgucgagaucgcccucuaccagcccauguccgggugcuacauccacuucuuccgcgagcccaccgaccugaagcaguucaagcaggacgcgaaguacagccacggcaucgacguggccgaccuguucccggcccagcccggccucaccuccgccgucaucgaggcccugccccggaacauggugcugaccugccaggggagcgacgacaucaagcgccuccuggacagccagggccggcgcgacaucaagcugaucgacaucgcgcucuccaaggccgacagccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucuccggcggccucaacaucccggugcugcgggccgugcugccccgcgacauggucuuccggaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5159 - RNA, 1927 nt, Artificial Sequence
  mRNA product Design1 comprising derived and/or modified sequence from Lassa virus__AIT17659__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcuguccaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccagcgccgugaucgaggcgcugccccggaacauggugcugaccugccagggguccgacgacaucaagcgccuccuggacagccagggccgccgggacaucaagcugaucgacaucgcccucaacaaggccgacucccgccgguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5160 - RNA, 1927 nt, Artificial Sequence
  mRNA product Design1 comprising derived and/or modified sequence from Lassa virus__AIT17663__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccgucgagaucgcgcucuaccagcccaugagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5161 - RNA, 1927 nt, Artificial Sequence
  mRNA product Design1 comprising derived and/or modified sequence from Lassa virus__AIT17667__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccaucgacggcauccugaaguccauccucaaggugaagaagucccuggggauguucgugagcgacacccccggcgagcggaaccccuacgagaacauccuguacaagaucugccucagcggggacggcuggccguacaucgcgucccgcaccagcaucgucgggcgggccugggagaacaccaccguggaccuggaguccgacggcaagccccagaaggugggcaccacggggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacgugaccgaccuguucccggcccagcccggccucaccagcgccgucaucgaggcccugccccgcaacauggugcugacgugccaggggagcgaggacaucaagcggcuccuggacucccagggccgccgcgacaucaagcugaucgacaucgcccucagcaaggcggacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgccgccgucagcggcggccucaacaucccggugcugcgcgcggugcugccccgggacauggucuuccgcaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5162 - RNA, 1927 nt, Artificial Sequence
  mRNA product Design1 comprising derived and/or modified sequence from Lassa virus__AIT17671__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacguggugcucgcccugaccgaccugggccucaucuacaccgccaaguaccccaacagcuccgaccuggaccgccugagccagagccacccgauccucaacauggucgacaccaagaaguccagccugaacaucuccggcuacaacuucagccugggggcggccgugaaggccggcgccugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggcgugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccgucgagaucgcccucuaccagcccaugagcgggugcuacauccacuucuuccgggagcccacggaccugaagcaguucaagcaggacgcgaaguacucccacggcaucgacgugaccgaccuguucccggcccagcccggccucaccagcgccgugaucgaggcccugccccgcaacaugguccugaccugccaggggagcgacgacaucaagcggcuccuggacucccagggccgccgcgacaucaagcugaucgacaucgcccucagcaaggcggacucccggcgcuucgagaacgccgugugggaccagugcaaggaccugugccacaugcacacggggguggucguggagaagaagaagcggggcgggaaggaggagaucacgccccacugcgcccugauggacugcaucauguacgacgccgccgugagcggcggccucaacaucccgguccugcgcgcggugcugccccgggacaugguguuccgcaccuccagccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5163 - RNA, 1927 nt, Artificial Sequence
  mRNA product Design1 comprising derived and/or modified sequence from Lassa virus__AIT17675__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacgccgugcucgcccugaccgaccugggccucaucuacaccgcgaaguaccccaacagcuccgaccuggaccgccugagccagagccacccgauccucaacaugguggacaccaagaaguccagccugaacaucuccggcuacaacuucagccugggggccgccgucaaggccggcgccugcaugcucgacgggggcaacaugcuggagacgaucaaggugacgccccagaccauggacggcauccugaaguccauccucaaggugaagaagucccuggggauguucgucagcgacacccccggcgagcggaaccccuacgagaacauccuguacaagaucugccucagcggggacggcuggccguacaucgcgucccgcaccagcaucguggggcgggccugggagaacaccaucguggaccuggaguccgacggcaagccccagaaggucggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccaccgaccugaagcaguucaagcaggacgccaaguacucccacggcaucgacgucgccgaccuguucccggcccagcccggccucacgagcgccgugaucgaggcgcugccccgcaacauggugcugaccugccaggggagcgacgacaucaagcggcuccuggacucccagggccgccgcgacaucaagcugaucgacaucgcccucagcaaggccgacucccggcgcuucgagaacgccgucugggaccagugcaaggaccugugccacaugcacaccggggugguggucgagaagaagaagcggggcgggaaggaggagaucacgccccacugcgcccugauggacugcaucauguacgacgcggccgugagcggcggccucaacaucccggugcugcgcgccguccugccccgggacaugguguuccgcaccuccagccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5164 - RNA, 1927 nt, Artificial Sequence
  mRNA product Design1 comprising derived and/or modified sequence from Lassa virus__AIT17679__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaguccacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaacaugguggacaccaagaaguccagccugaacaucagcggcuacaacuucucccugggcgccgccgugaaggccggggccugcaugcucgacggcgggaacaugcuggagacgaucaaggucacgccccagaccauggacggcauccucaagagcauccugaaggugaagcggucccugggcauguucgugagcgacacccccggggagcgcaaccccuacgagaacauccuguacaagaucugccucuccggcgacggguggccguacaucgcgagccggaccuccaucgucggccgcgccugggagaacaccaccguggaccuggagagcgacgggaagccccagaaggugggcaccgccggcuccaacaagagccugcaguccgccggguuccccacgggccucaccuacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccacggaccugaagcaguucaagcaggacgccaaguacagccacgggaucgacguggccgaccuguucccggcccagcccggccucaccagcgccgucaucgaggcgcugccccggaacauggugcugaccugccagggcuccgacgacaucaagcgccuccuggacagccaggggcgccgggacaucaagcugaucgacaucgcccucuccaaggccgacagccgccgguucgagaacgccgugugggaccagugcaaggaccugugccacaugcacaccggcgucgugguggagaagaagaagcgcgggggcaaggaggagaucacgccccacugcgcccugauggacugcaucauguacgacgcggccgucuccgggggccucaacaucccggugcugcgggccgugcugccccgcgacauggucuuccggaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5165 - RNA, 1927 nt, Artificial Sequence
  mRNA product Design1 comprising derived and/or modified sequence from Lassa virus__AIT17683__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuucaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5166 - RNA, 1927 nt, Artificial Sequence
  mRNA product Design1 comprising derived and/or modified sequence from Lassa virus__AIT17687__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuacaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5167 - RNA, 1927 nt, Artificial Sequence
  mRNA product Design1 comprising derived and/or modified sequence from Lassa virus__AIT17695__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgucgugcuggcccugaccgaccucgggcugaucuacaccgccaaguaccccaacuccagcgaccuggaccgccucucccagagccacccgauccugaacaugguggacaccaagaaguccagccugaacaucagcggcuucaacuucucccucggggcggccgucaaggccggcgccugcaugcuggacgggggcaacaugcuggagacgaucaaggugacgccccacaccauggacggcauccucaagagcauccugaaggugaagaagucccuggggauguucgucagcgacacccccggcgagcggaaccccuacgagaacauccucuacaagaucugccuguccggggacggcuggccguacaucgccagccgcaccuccaucguggggcgggcgugggagaacaccaccguggaccuggagagcgacggcaagccccacaaggucggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccguggagaucgcccuguaccagcccauguccgggugcuacauccacuucuuccgggagcccacggaccugaagcaguucaagcaggacgcgaaguacagccacggcaucgacgucgccgaccucuucccggcccagcccggccugaccuccgccgugaucgaggcccugccccgcaacauggugcugaccugccaggggagcgacgacaucaagcggcuccuggacagccagggccgccgcgacaucaagcucaucgacaucgcgcuguccaaggccgacagccggcgcuucgagaacgccgucugggaccagugcaaggaccugugccacaugcacaccggggugguggucgagaagaagaagcggggcgggaaggaggagaucacgccccacugcgcccucauggacugcaucauguacgacgccgcgguguccggcggccugaacaucccggugcugcgcgccguccucccccgggacaugguguuccgcaccagcucccccaaggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5168 - RNA, 1927 nt, Artificial Sequence
  mRNA product Design1 comprising derived and/or modified sequence from Lassa virus__AIT17705__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaaccgcagccuccaguccgccggcuuccccacggggcugaccuacagccagcugaugacccugaaggacuccaugaugcagcucgaccccagcgccaagaccuggaucgacaucgagggccggccggaggaccccgucgagaucgcgcuguaccagcccauguccgggugcuacauccacuucuuccgcgagcccacggaccugaagcaguucaagcaggacgccaaguacagccacggcaucgacguggccgaccucuucccggcccagcccggccugaccuccgccgucaucgaggcgcugccccggaacauggugcugaccugccaggggagcgacgacaucaagcgccuccuggacagccagggccgccgggacaucaagcucaucgacaucgcccuguccaaggccgacagccgccgguucgagaacgccgugugggaccagugcaaggaccugugccacaugcacaccggggucgugguggagaagaagaagcgcggcgggaaggaggagaucacgccccacugcgcccucauggacugcaucauguacgacgcggccgucuccggcggccugaacaucccggugcugcgggccgugcucccccgcgacauggucuuccggaccagcucccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5169 - RNA, 1927 nt, Artificial Sequence
  mRNA product Design1 comprising derived and/or modified sequence from Lassa virus__AIT17711__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccagcaagucccuccagagcgccggcuuccccacggggcugaccuacucccagcugaugacccugaaggacagcaugaugcagcucgaccccuccgccaagaccuggaucgacaucgagggccgcccggaggaccccgucgagaucgcgcuguaccagcccaugagcgggugcuacauccacuucuuccgggagcccacggaccugaagcaguucaagcaggacgccaaguacucccacggcaucgacguggccgaccucuucccggcccagcccggccugaccagcgccgucaucgaggcgcugccccgcaacauggugcugaccugccaggggagcgacgacaucaagcggcuccuggacucccagggccgccgcgacaucaagcucaucgacaucgcccugagcaaggccgacucccggcgcuucgagaacgccgugugggaccagugcaaggaccugugccacaugcacaccggggucgugguggagaagaagaagcggggcgggaaggaggagaucacgccccacugcgcccucauggacugcaucauguacgacgcggccgucagcggcggccugaacaucccggugcugcgcgccgugcucccccgggacauggucuuccgcaccuccagccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5170 - RNA, 1927 nt, Artificial Sequence
  mRNA product Design1 comprising derived and/or modified sequence from Lassa virus__AIT17713__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaucaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacguccgccgucaucgaggcgcugccccgcaacauggugcugaccugccaggggagcgacgacaucaagcggcuccuggacagccagggccgccgcgacaucaagcugaucgacaucgcccucaacaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5171 - RNA, 1927 nt, Artificial Sequence
  mRNA product Design1 comprising derived and/or modified sequence from Lassa virus__AIT17719__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucuccggcgcgcagggcacccagccggggcgcgacggcguggugcgggucugggacgugaagaaccccgagcuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaacaugguggacaccaagaaguccagccugaacaucagcggcuacaacuucucccugggcgccgccgugaaggccggggccugcaugcucgacggcgggaacaugcuggagacgaucaaggucacgccccagaccauggacggcauccucaagagcauccugaaggugaagaagucccugggcauguucgugagcgacacccccggggagcggaaccccuacgagaacauccuguacaagaucugccucuccggcgacggguggccguacaucgcgagccgcaccuccaucgucggccgggccugggagaacaccaccguggaccuggagagcgacgggaagccccagaaggugggcaccgccggcuccaacaagagccugcaguccgccggguuccccacgggccucaccuacagccagcugaugacccugaaggacuccaugaugcagcuggaccccagcgccaagaccuggaucgacaucgaggggcgcccggaggaccccgucgagaucgcgcucuaccagcccauguccggcugcuacauccacuucuuccgggagcccacggaccugaagcaguucaagcaggacgccaaguacagccacgggaucgacguggccgaccuguucccggcccagcccggccucaccagcgccgucaucgaggcgcugccccgcaacauggugcugaccugccagggcuccgacgacaucaagcggcuccuggacagccaggggcgccgcgacaucaagcugaucgacaucucccucagcaaggccgacucccggcgcuucgagaacgccgugugggaccagugcaaggaccugugccacaugcacaccggcgucgugguggagaagaagaagcgcgggggcaaggaggagaucacgccccacugcgcccugauggacugcaucauguacgacgccgcggucagcgggggccucaacaucccggugcugcgggccgugcugccccgggacauggucuuccgcaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5172 - RNA, 1927 nt, Artificial Sequence
  mRNA product Design1 comprising derived and/or modified sequence from Lassa virus__AIT17725__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagcucggccgcgacgggguggugcgggucugggacgugaagaacccggaccugcugaacaaccaguucggcaccaugcccagccucacccuggccugccugaccaagcagggccagguggaccucaacgacgccguccuggcgcugacggaccucgggcugaucuacaccgccaaguaccccaacuccagcgaccuggaccgccucucccagagccaccccauccugaacaugguggacaccaagaaguccagccugaacaucagcggcuacaacuucucccucggggccgccgugaaggccggcgcgugcaugcuggacgggggcaacaugcuggagaccaucaaggucacgccgcagaccauggacggcauccucaagagcauccugaaggugaagaagucccuggggauguucgugagcgacacccccggcgagcggaaccccuacgagaacauccucuacaagaucugccuguccggggacggcuggcccuacaucgccagccgcaccuccaucgucgggcgggccugggagaacacgaccguggaccuggagagcgacggcaagccgcagaaggugggcaccgccggguccaacaagagccuccaguccgccggcuuccccaccgggcugacguacagccagcugaugacccugaaggacuccaugaugcagcucgaccccagcgcgaagaccuggaucgacaucgagggccgccccgaggacccggucgagaucgcccuguaccagcccauguccgggugcuacauccacuucuuccgggagcccaccgaccugaagcaguucaagcaggacgccaaguacagccacggcaucgacguggccgaccucuuccccgcccagccgggccugacguccgcggucaucgaggcccugccccgcaacauggugcugaccugccaggggagcgaggacaucaagcggcuccuggacagccagggccgccgcgacaucaagcucaucgacaucgcccuguccaaggccgacagccggcgcuucgagaacgccgugugggaccagugcaaggaccugugccacaugcacaccggggucgugguggagaagaagaagcggggcgggaaggaggagaucacgccccacugcgcgcucauggacugcaucauguacgacgccgccgucuccggcggccugaacauccccgugcugcgcgccgugcucccgcgggacauggucuuccgcaccagcucccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5173 - RNA, 1927 nt, Artificial Sequence
  mRNA product Design1 comprising derived and/or modified sequence from Lassa virus__AIT17729__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacccugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcacccaggggacccagccgggccgggacgggguggugcgcgucugggacgugaagaaccccgaccuccugaacaaccaguucggcaccaugcccucccugacgcucgcgugccugaccaagcagggccagguggaccugaacgacgccguccucgcccugaccgaccuggggcucaucuacaccgccaaguaccccaacagcuccgaccuggaccggcugagccagagccacccgauccucaacaugguggacacgaagaaguccagccugaacaucuccggcuacaacuucagccugggggcggccgugaaggccggcgccugcaugcucgacgggggcaacaugcuggagaccaucaaggucacgccccagaccauggacggcauccugaaguccauccucaaggugaagcgcagccuggggauguucguguccgacacccccggcgagcggaaccccuacgagaacauccuguacaagaucugccucagcggggacggcuggccguacaucgccucccgcaccagcaucgucgggcgggcgugggagaacaccaccguggaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacguggccgaccuguucccggcccagcccggccucaccagcgccgucaucgaggcccugccccgcaacauggugcugaccugccaggggagcgacgacaucaagcgccuccuggacucccagggccggcgcgacaucaagcugaucgacaucgcgcucagcaaggccgacucccggaaguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5174 - RNA, 1927 nt, Artificial Sequence
  mRNA product Design1 comprising derived and/or modified sequence from Lassa virus__AIT17733__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucauccuggccgccgaccuggagaagcucaagagcaaggugauccgcaccgagcggccccuguccagcgggguguacaugggcaaccuguccacccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacguccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5175 - RNA, 1927 nt, Artificial Sequence
  mRNA product Design1 comprising derived and/or modified sequence from Lassa virus__AIT17745__NP (opt1)
gggagaaagcuuaccaugagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaagguggacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5176 - RNA, 1927 nt, Artificial Sequence
  mRNA product Design1 comprising derived and/or modified sequence from Lassa virus__AIT17753__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcaccacggggagcaacaagucccugcagagcgccggcuuccccaccgggcucaccuacucccagcugaugacccugaaggacagcaugaugcagcuggaccccuccgccaagacguggaucgacaucgagggccggccggaggaccccgucgagaucgcccucuaccagcccaugagcgggugcuacauccacuucuuccgcgagcccaccgaccugaagcaguucaagcaggacgcgaaguacucccacggcaucgacguggccgaccuguucccggcccagcccggccucaccagcgccgucaucgaggcccugccccggaacauggugcugaccugccaggggagcgacgacaucaagcgccuccuggacucccagggccgccgggacaucaagcugaucgacaucgcgcucagcaaggccgacucccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5177 - RNA, 1927 nt, Artificial Sequence
  mRNA product Design1 comprising derived and/or modified sequence from Lassa virus__AIT17763__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcggagccuggggauguucgucuccgacacccccggcgagcgcaaccccuacgagaacauccuguacaagaucugccucagcggggacggcuggccguacaucgcgucccggaccagcaucguggggcgcgccugggagaacaccaccguggaccuggaguccgacgagaagccccagaaggucggcgccgccggcagcaacaagucccugcagagcgccggguuccccaccggccucacguacucccagcugaugacccugaaggacagcaugaugcagcuggaccccuccgcgaagaccuggaucgacaucgaggggcggccggaggaccccguggagaucgcccucuaccagcccaugagcggcugcuacauccacuucuuccgcgagcccaccgaccugaagcaguucaagcaggacgccaaguacucccacgggaucgacgucacggaccuguucccggcccagcccggccucaccagcgccgugaucgaggcgcugccccggaacauggugcugaccugccagggcagcgacgacaucaagcgccuccuggacucccaggggcgccgggacaucaagcugaucgacaucgcccucagcaaggccgacucccgccgguucgagaacgccgucugggaccagugcaaggaccugugccacaugcacaccggcgugguggucgagaagaagaagcgcgggggcaaggaggagaucacgccccacugcgcccugauggacugcaucauguacgacgcggccgugagcgggggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5178 - RNA, 1927 nt, Artificial Sequence
  mRNA product Design1 comprising derived and/or modified sequence from Lassa virus__AIT17771__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagacccagaaggugagcacggccggcuccaacaagagccugcaguccgccggguuccccaccggccucaccuacagccagcugaugacccugaaggacuccaugaugcagcuggaccccagcgccaagacguggaucgacaucgaggggcggcccgaggacccggucgagaucgcgcucuaccagcccauguccggcugcuacauccacuucuuccgcgagcccaccgaccugaagcaguucaagcaggacgccaaguacagccacgggaucgacgugaccgaccuguuccccgcccagccgggccucaccagcgccgucaucgaggcccugccccggaacauggugcugacgugccagggcuccgacgacaucaagcgccuccuggacagccaggggcgccgggacaucaagcugaucgacaucgcgcucuccaaggccgacagccgccgguucgagaacgccgugugggaccagugcaaggaccugugccacaugcacaccggcgucgugguggagaagaagaagcgcgggggcaaggaggagaucacgccccacugcgcccugauggacugcaucauguacgacgccgcggucuccgggggccucaacauccccgugcugcgggccgugcugccgcgcgacauggucuuccggaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5179 - RNA, 1927 nt, Artificial Sequence
  mRNA product Design1 comprising derived and/or modified sequence from Lassa virus__AIT17779__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaagacggacagccggcgcuucgagaacgccgugugggaccagugcaaggaccugugccacaugcacaccggcgucgugguggagaagaagaagcgcgggggcaaggaggagaucacgccccacugcgcccugauggacugcaucauguacgacgccgccgucuccggcgggcucaacauccccgugcugcgggcggugcugccgcgggacauggucuuccgcaccagcucccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5180 - RNA, 1927 nt, Artificial Sequence
  mRNA product Design1 comprising derived and/or modified sequence from Lassa virus__AIT17783__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgucgugcucgcccugaccgaccuggggcucaucuacaccgccaaguaccccaacuccagcgaccuggaccgccugucccagagccacccgauccucaacaugguggacaccaagaaguccagccugaacaucagcggcuacaacuucucccugggggcggccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgccagccgcaccuccaucguggggcgggcgugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccguggagaucgcccucuaccagcccgucuccgggugcuacauccacuucuuccgggagcccacggaccugaagcaguucaagcaggacgcgaaguacagccacggcaucgacguggccgaccuguucccggcccagcccggccucaccuccgccgugaucgaggcccugccccgcaacaugguccugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgccgcgguguccggcggccucaacaucccgguccugcgcgccgugcugccccgggacaugguguuccgcaccagcucccccaaggucgugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5181 - RNA, 1927 nt, Artificial Sequence
  mRNA product Design1 comprising derived and/or modified sequence from Lassa virus__AIT17787__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaagguggacagccggcgcuucgagaacgccgucugggaccagugcaaggaccugugccacaugcacacgggcgugguggucgagaagaagaagcgcgggggcaaggaggagaucacgccccacugcgcccugauggacugcaucauguacgacgccgccguguccggcgggcucaacauccccgugcugcgggcgguccugccgcgggacaugguguuccgcaccagcucccccaaggugguccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5182 - RNA, 1927 nt, Artificial Sequence
  mRNA product Design1 comprising derived and/or modified sequence from Lassa virus__AIT17803__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcucccaggaggcccgggccgggcgcgacggcgugguccgggugugggacgugaagaacgccgagcuccugaacaaccaguucgggaccaugccgagccugacgcucgcgugccugaccaagcagggccaggucgaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggcgccgcggugaaggccggggccugcaugcuggacggcgggaacaugcucgagaccaucaaggucagcccccagacgguggacggcauccugaaguccauccugaaggugaagaaggcccucggcauguucaucagcgacaccccgggggagcggaaccccuacgagaacauccuguacaagaucugccuguccggcgacggguggcccuacaucgccagccgcaccuccaucaccggccgggcgugggagaacacggucguggaccucgagagcgacgggaagccccagaaggccggcuccaacaacagcaacaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgucaccgaccuguucgccgcccagcccgggcucaccuccgcggugaucgacgcccugccccgcaacauggugaucacgugccagggcagcgacgacauccgcaagcugcucgagagccagggccggaaggacaucaagcugaucgacaucgcccuguccaagaccgacagccgcaaguacgagaacgccgucugggaccaguacaaggaccucugccacaugcacaccgggguggucguggagaagaagaagaagggcgggaaggaggagaucacgccccacugcgcgcugauggacugcaucauguucgacgccgccguguccggcgggcugaacaccagcguccuccgggccgugcugccgcgcgacaugguguuccggaccuccacgccccgcgucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5183 - RNA, 1927 nt, Artificial Sequence
  mRNA product Design1 comprising derived and/or modified sequence from Lassa virus__AIT17811__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgccuucuaccagcccuccagcggcugcuacauccacuucuuccgggagccgaccgaccucaagcaguucaagcaggacgccaaguacucccacgggaucgacgugaccgaccuguucgccgcccagcccggccugacgagcgcggucaucgacgcccucccccgcaaccuggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacgccuccgugcugcgggccgugcucccccgggacauggucuuccgcaccagcacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5184 - RNA, 1927 nt, Artificial Sequence
  mRNA product Design1 comprising derived and/or modified sequence from Lassa virus__AIT17815__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuggacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgggacauggucuuccgcaccagcacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5185 - RNA, 1927 nt, Artificial Sequence
  mRNA product Design1 comprising derived and/or modified sequence from Lassa virus__AIT17821__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgguggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacggucguggaccucgaguccgacggcaagccccagaagaccggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccguggaggucgcgcucuaccagcccuccagcggcugcuacauccacuucuuccgggagccgaccgaccugaagcaguucaagcaggacgccaaguacucccacgggaucgacgugaccgaccuguucgccgcccagcccggccucacgagcgccgugaucgacgcgcugccccgcaacauggucaucacgugccagggcuccgacgacauccgcaagcugcucgagagccaggggcggaaggacaucaagcugaucgacaucgcccugagcaagaccgacucccgcaaguacgagaacgccgugugggaccaguacaaggaccucugccacaugcacaccggcgucgugguggagaagaagaagcgcgggggcaaggaggagaucaccccgcacugcgcccugauggacugcaucauguucgacgcggccgucagcgggggccugaacaccuccgugcuccgggccgugcugccccgggacauggucuuccgcaccagcacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5186 - RNA, 1927 nt, Artificial Sequence
  mRNA product Design1 comprising derived and/or modified sequence from Lassa virus__AIT17837__NP (opt1)
gggagaaagcuuaccaugagcaacuccaaggagaucaagagcuuccuguggacccagucccuccgccgggagcugagcggcuacugcuccaacaucaagcuccagguggucaaggacgcccaggcccugcugcacgggcuggacuucagcgagguguccaacgugcagcgccucaugcggaagcagaagcgcgacgacgcggaccugaagcggcugcgcgaccucaaccaggccgucaacaaccugguggagcucaagagcacccagcagaagaacgugcugcgggucggcacgcuguccagcgacgaccugaucacccucgccgccgaccuggagaagcugaaguccaaggugauccgcaccgagcggccccucagcuccgggguguacaugggcaaccugagcucccagcagcuggaccagcgccgggcccuccugagcaugaucgggauguccggcggcccgcaggggaaccgcaccggcggggacggcgucgugcgggugugggacgucaagaacgcggagcugcucaacaaccaguucgggacgaugcccagccugacccuggccugccucaccaagcagggccagguggaccugaacgacgccgugcaggcccugaccgaccucggccugaucuacacggcgaaguaccccaacuccagcgaccuggacaugcucacccagagccaccccauccuggggauggucgacaccaagaaguccagccugaacaucuccggcuacaacuucagccucggggccgccgugaaggccggcgccugcaugcuggacggcgggaacaugcuggagaccaucaagguguccccgcagacgauggacggcauccucaagagcauccugaaggucaagcgcucccuggggauguucaucagcgacacccccggcgagcggaaccccuacgagaacauccucuacaagaucugccuguccggggagggcuggcccuacaucgcgagccgcaccuccaucaccggccgggccugggagaacacgcugguggaccucgagagcgacaacaagccgcccaagcugaacuccgccgggagcaacaagucccugcaggccgccggccucaacgcggggcugaccuacagccagcugaugacccugaaggacugcaugcuccagcuggaccccuccagcaagaccuggaucgacaucgagggccgccccgaggacccgguggagaucgcccuguuccagcccuccagcgggugcuacauccacuucuuccgggagcccacggaccucaagcaguucaagcaggacgccaaguacagccacggcaucgacgucaccgaccuguucuccacccagcccggccugaccagcgccgugaucgaggcccucccgcgcaacauggugcugacgugccagggguccgacgacaucaagaagcugcucgagagccagggccggcgcgacaucaagcugaucgacaucucccugagcaaggcggacucccgcaaguucgagaacgccgucugggaccaguacaaggaccucugccacaugcacaccgggguggucguggagaagaagaagcggggcgggaaggaggagaucacgccccacugcgcccugcuggacugcaucauguucgacgccgccaccaccggcagccucaacaucaccacccugcgcgcggugcugccccgggacauggucuuccgcaccuccacgcccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5187 - RNA, 1927 nt, Artificial Sequence
  mRNA product Design1 comprising derived and/or modified sequence from Lassa virus__AIT17841__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggacggggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcccagcccggccucacgagcgcggucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacaccuccgugcugcgggccgugcucccccgggacauggucuuccgcaccagcacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5188 - RNA, 1927 nt, Artificial Sequence
  mRNA product Design1 comprising derived and/or modified sequence from Lassa virus__AIT17845__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccagacggggcgggacggcgugguccgcgugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccggcugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgccucccggaccagcaucacgggccgcgcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugaccgaccuguucgccgcccagcccggccucacgagcgcggucaucgacgcccugccccggaacauggugaucacgugccagggcuccgacgacauccgcaagcuguucgagagccaggggcgcaaggacaucaagcucaucgacaucgcccugagcaagaccgacucccggaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacaccuccgugcugcgggccgugcucccccgcgacauggucuuccggaccagcacgccccgcguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5189 - RNA, 1927 nt, Artificial Sequence
  mRNA product Design1 comprising derived and/or modified sequence from Lassa virus__ANH09723__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucacccuggccgccgaccuggagaagcucaaguccaaggugacccggacggagcgcccccugaccgccgggguguacaugggcaaccugagcucccagcagcucgaccagcggcgcgcgcugcugaacaugaucgggaugagcggcggcaaccagggggcccggaccggccgcgacggggucgugcgggugugggacgucaagaacgccgagcuccugaacaaccaguucggcaccaugccgucccugacgcucgccugccugaccaagcagggccagguggaccugaacgacgugguccaggcgcucaccgaccuggggcugaucuacaccgccaaguaccccaacacgagcgaccucgaccgccugacccagucccaccccauccugaacaugaucgacaccaacaagagcucccucaacaucagcggcuacaacuucagccugggggccgccgugaaggccggcgcgugcaugcuggacgggggcaacaugcucgagaccaucaaggugagcccccagacgauggacggcauccucaagagcauccugaaggucaagaagucccuggggauguucaucagcgacaccccgggcgagcggaaccccuacgagaacauccuguacaagaucugccuguccggggacggcuggcccuacaucgccagccgcaccuccaucaccgggcgggccugggagaacacggugguggaccucgagagcggcggcaagccccagaaggccggguccaacaacagcaacaagucccugcagagcgccggcuucgcggccgggcugaccuacucccagcucaugacccugaaggacgccaugcugcagcuggacccgaacgccaagaccuggauggacaucgagggccgccccgaggaccccgucgagaucgcccucuaccagcccaucagcgggugcuacauccacuucuuccgggagccgacggaccugaagcaguucaagcaggacgcgaaguacucccacggcaucgacgugaccgaccuguucgccgcccagcccggccucaccagcgccgugaucgaggcccugccccgcaacauggucaucacgugccagggguccgacgacauccgcaagcuguucgagagccagggccggaaggacaucaagcucaucgacaucgcgcuguccaagaccgacagccgcaaguacgagaacgccgugugggaccaguacaaggaccugugccacaugcacaccggggucgugguggagaagaagaagaagggcgggaaggaggagaucacgccccacugcgcccucauggacugcaucauguucgacgccgcggucagcggcggccugaacacccuggugcuccgggccgugcugccgcgcgacauggucuuccggaccuccacccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5190 - RNA, 1927 nt, Artificial Sequence
  mRNA product Design1 comprising derived and/or modified sequence from Lassa virus__ANH09725__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgaccuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaacaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaagucccucgggauguucaucagcgacaccccgggcgagcggaaccccuacgagaacauccuguacaagaucugccugagcggggacggcuggcccuacaucgccucccgcaccagcaucacggggcgggccugggagaacaccgugguggaccucgaguccggcggcaagccccagaaggccgggagcaacaacuccaacaagagccugcaguccgcgggcuucgccgccgggcugaccuacagccagcucaugacccugaaggacgccaugcugcagcuggacccgaacgccaagacguggauggacaucgagggccgccccgaggaccccgucgagaucgcgcucuaccagcccaucuccgggugcuacauccacuucuuccgggagccgaccgaccugaagcaguucaagcaggacgccaaguacagccacggcaucgacgugaccgaccuguucgccgcccagcccggccucaccuccgccgugaucgaggcgcugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccggggucgugguggagaagaagaagcggggcgggaaggaggagaucacgccccacugcgcccugauggacugcaucauguucgacgcggccgucuccggcggccugaacacccucgugcugcgcgccgugcugccgcgggacauggucuuccgcaccagcacccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5191 - RNA, 1927 nt, Artificial Sequence
  mRNA product Design1 comprising derived and/or modified sequence from Lassa virus__ANH09729__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccuccgacgaccugcucacccuggccgccgaccuggagaagcucaagagcaaggugacccggacggagcgcccccuguccgccgggguguacaugggcaaccugagcucccagcagcucgaccagcggcgcgcgcugcugaacaugaucgggaugagcggcggcaaccagggggcccggaccggccgcgacggggucgugcgggugugggacgucaagaacgccgaccuccugaacaaccaguucggcaccaugccgucccugacccucgccugccugacgaagcagggccagguggaccugaacgacgugguccaggcgcucaccgaccuggggcugaucuacaccgccaaguaccccaacaccagcgaccucgaccgccugacgcagucccaccccauccugaacaugaucgacaccaacaagagcagccucaacaucuccggcuacaacuucagccugggggccgccgugaaggccggcgcgugcaugcuggacgggggcaacaugcucgagaccaucaaggugagcccccagaccauggacggcauccucaagagcauccugaaggucaagaagucccuggggauguucaucagcgacacgccgggcgagcggaaccccuacgagaacauccuguacaagaucugccuguccggggacggcuggcccuacaucgccagccgcaccuccaucaccgggcgggccugggagaacaccgugguggaccucgagagcggcggcaagccccagcgcgccggguccaacaacagcaacaagucccugcagagcgccggcuucgcggccgggcugacguacucccagcucaugacccugaaggacgccaugcugcagcuggacccgaacgccaagaccuggauggacaucgagggccggcccgaggaccccgucgagaucgcccucuaccagcccaccagcgggugcuacauccacuucuuccgcgagccgacggaccugaagcaguucaagcaggacgcgaaguacucccacggcaucgacgugaccgaccuguucgccgcccagcccggccucaccagcgccgugaucgaggcccugccccgcaacauggucaucacgugccagggguccgacgacauccggaagcugcucgagagccagggccgcaaggacaucaagcugaucgacaucgcgcugagcaagaccgacucccggaaguacgagaacgccgugugggaccaguacaaggaccucugccacaugcacaccggggucgugguggagaagaagaagaagggcgggaaggaggagaucacgccccacugcgcccugauggacugcaucauguucgacgccgcggucagcggcggccugaacacccucgugcugcgcgccgugcugccgcgggacauggucuuccgcaccuccacccccaagguggugcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5192 - RNA, 1927 nt, Artificial Sequence
  mRNA product Design1 comprising derived and/or modified sequence from Lassa virus__ANH09731__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucacccuggccgccgaccuggagaagcucaaguccaaggugacccggacggagcgcccccugagcgccgggguguacaugggcaaccuguccagccagcagcucgaccagcggcgcgcgcugcugaacaugaucgggaugaccggcggcaaccagggggcccggaccggccgcgacggggucgugcgggugugggacgucaagaacgccgaccuccugaacaaccaguucggcaccaugccgucccugacgcucgccugccugaccaagcagggccagguggaccugaacgacgugguccaggcgcucaccgaccuggggcugaucuacaccgccaaguaccccaacacgagcgaccucgaccgccugacccagucccaccccauccugaacaugaucgacaccaacaagagcucccucaacaucagcggcuacaacuucagccugggggccgccgugaaggccggcgcgugcaugcuggacgggggcaacaugcucgagaccaucaaggugagcccccagacgauggacggcauccucaagagcauccugaaggucaagaagucccuggggauguucaucagcgacaccccgggcgagcggaaccccuacgagaacauccuguacaagaucugccuguccggggacggcuggcccuacaucgccagccgcaccuccaucaccgggcgggccugggagaacacggugguggaccucgagagcggcggcaagccccagcgcgccggguccaacaacagcaacaagucccugcagagcgccggccuggcggccgggcucaccuacucccagcugaugacccugaaggacgccaugcugcagcucgacccgaacgccaagaccuggauggacaucgagggccggcccgaggaccccgucgagaucgcccuguaccagcccacgagcgggugcuacauccacuucuuccgcgagccgaccgaccugaagcaguucaagcaggacgcgaaguacucccacggcaucgacgugaccgaccucuucgccgcccagcccggccugaccagcgccgugaucgaggcccugccccgcaacauggucaucacgugccagggguccgacgacauccggaagcuccuggagagccagggccgcaaggacaucaagcugaucgacaucgcgcucuccaagaccgacagccggaaguacgagaacgccgugugggaccaguacaaggaccugugccacaugcacaccggggucgugguggagaagaagaagaagggcgggaaggaggagaucacgccccacugcgcccugauggacugcaucauguucgacgccgcggucagcggcggccucaacacccuggugcugcgcgccgugcucccgcgggacauggucuuccgcaccuccacccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5193 - RNA, 1927 nt, Artificial Sequence
  mRNA product Design1 comprising derived and/or modified sequence from Lassa virus__ANH09733__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucacccuggccgccgaccuggagaagcucaaguccaaggugacccggacggagcgcccccugagcgccgggguguacaugggcaaccuguccagccagcagcucgaccagcggcgcgcgcugcugaacaugaucgggauguccggcggcaaccagggggcccggaccggccgcgacggggucgugcgggugugggacgucaagaacgccgaccuccugaacaaccaguucggcaccaugccgagccugacccucgccugccugacgaagcagggccagguggaccugaacgacgugguccaggcgcucaccgaccuggggcugaucuacaccgccaaguaccccaacaccuccgaccucgaccgccugacgcagagccaccccauccugaacaugaucgacaccaacaaguccagccucaacaucagcggcuacaacuucucccugggggccgccgugaaggccggcgcgugcaugcuggacgggggcaacaugcucgagaccaucaaggugagcccccagaccauggacggcauccugaaguccauccugaaggucaagaagucccucgggauguucaucagcgacacgccgggcgagcggaaccccuacgagaacauccuguacaagaucugccugagcggggacggcuggcccuacaucgccucccgcaccagcaucaccgggcgggccugggagaacaccgugguggaccucgaguccggcggcaagccccagcgcgccgggagcaacaacuccaacaagagccugcaguccgccggcuucgcggccgggcugacguacagccagcucaugacccugaaggacgccaugcugcagcuggacccgaacgccaagaccuggauggacaucgagggccggcccgaggaccccgucgagaucgccuucuaccagcccaucuccgggugcuacauccacuucuuccgcgagccgaccgaccucaagcaguucaagcaggacgcgaaguacagccacggcaucgacgugacggaccuguucgccgcccagcccggccugaccuccgccgugaucgaggcccucccccgcaacauggucaucacgugccaggggagcgacgacauccggaagcugcuggagucccagggccgcaaggacaucaagcucaucgacaucgcgcugagcaagaccgacagccggaaguacgagaacgccgugugggaccaguacaaggaccugugccacaugcacaccggggucgugguggagaagaagaagaagggcgggaaggaggagaucacgccccacugcgcccucauggacugcaucauguucgacgccgcggucuccggcggccugaacacccuggugcuccgcgccgugcugccgcgggacauggucuuccgcaccagcacccccaagguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5194 - RNA, 1927 nt, Artificial Sequence
  mRNA product Design1 comprising derived and/or modified sequence from Lassa virus__ANH09735__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacgaacggcggccagggggcgaacgccggccgggacgggaucguccgcgugugggacgugaagaacgccgagcuccugaacaaccaguucggcaccaugcccucccugacccucgccugccugaccaagcaggggcaggucgaccugaacgacgcggugcaggcccucacggaccugggccugaucuacaccgccaaguaccccaacagcuccgaccucgaccggcugagccagaaccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagacgauggacggcauccugaaguccauccugaaggugaagcgcagccucgggauguucguguccgacaccccgggcgagcggaaccccuacgagaacauccuguacaagaucugccugagcggggacggcuggcccuacgucgccucccgcaccagcaucaucgggcgggccugggagaacaccgugguggaccucgaguccgacagcaagccccagcgcccgggcuccaaggagagcaaccggucccugcagacggccggcuuccccgcggggcugaccuacagccagcucaugacccugaaggacuccaugcugcagcuggaccccaacgccaagaccuggauggacaucgagggccgccccgacgacccggucgagaucgcccucuaccagcccagcuccgggugcuacauccacuucuuccgcgagcccacggaccugaagcaguucaagcaggacgccaaguacagccacggcaucgacaucggggaccuguucgccgcgcagcccggccucaccagcgccgugaucgaggcccugccgcggaacauggugaucacgugccagggcuccgaggacaucaagcgccugcucgagagccaggggcggaaggacauccgccuggucgacaucucccugagcaaggccgacucccggaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgcgcggugcugcccaaggacauggucuuccggaccagcacgccccgcguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5195 - RNA, 1927 nt, Artificial Sequence
  mRNA product Design1 comprising derived and/or modified sequence from Lassa virus__ANH09737__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacgaacggcggccagggggcgaacgccggccgggacgggaucguccgcgugugggacgugaagaacgccgagcuccugaacaaccaguucggcaccaugcccucccugacccucgccugccugaccaagcaggggcaggucgaccugaacgacgcggugcaggcccucacggaccugggccugaucuacaccgccaaguaccccaacagcuccgaccucgaccggcugagccagaaccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagacgauggacggcauccugaaguccauccugaaggugaagcgcagccucgggauguucguguccgacaccccgggcgagcggaaccccuacgagaacauccuguacaagaucugccugagcggggacggcuggcccuacgucgccucccgcaccagcaucaucgggcgggccugggagaacaccgugguggaccucgaguccgacagcaagccccagcgcccgggcuccaaggagagcaaccggucccugcagacggccggcuuccccgcggggcugaccuacagccagcucaugacccugaaggacuccaugcugcagcuggaccccaacgccaagaccuggauggacaucgagggccgccccgacgacccggucgagaucgcccucuaccagcccagcuccgggugcuacauccacuucuuccgcgagcccacggaccugaagcaguucaagcaggacgccaaguacagccacggcaucgacaugggggaccuguucgccgcgcagcccggccucaccagcgccgugaucgaggcccugccgcggaacauggugaucacgugccagggcuccgaggacaucaagcgccugcucgagagccaggggcggcgcgacauccggcuggucgacaucucccugagcaaggccgacucccgcaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgggcggugcugcccaaggacauggucuuccgcaccagcacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5196 - RNA, 1927 nt, Artificial Sequence
  mRNA product Design1 comprising derived and/or modified sequence from Lassa virus__ANH09739__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacguccggcggccagggggcgaacgccggccgggacgggaucguccgcgugugggacgugaagaacgccgagcuccugaacaaccaguucggcaccaugcccagccugacccucgccugccugaccaagcaggggcaggucgaccugaacgacgcggugcaggcccucacggaccugggccugaucuacaccgccaaguaccccaacuccagcgaccucgaccggcugagccagaaccaccccauccugaacaugaucgacaccaagaaguccagccucaacaucuccggcuacaacuucagccugggggccgccgugaaggcgggcgccugcaugcuggacgggggcaacaugcucgagaccaucaaggucagcccccagacgauggacggcauccucaagagcauccugaaggugaagcgcucccuggggauguucgugagcgacaccccgggcgagcggaaccccuacgagaacauccuguacaagaucugccuguccggggacggcuggcccuacgucgccagccgcaccuccaucaucgggcgggccugggagaacaccgugguggaccucgagagcgacuccaagccccagcgcccgggcagcaaggaguccaaccggagccugcagacggccggcuuccccgcggggcugaccuacucccagcucaugacccugaaggacagcaugcugcagcuggaccccaacgccaagaccuggauggacaucgagggccgccccgacgacccggucgagaucgcccucuaccagcccuccagcgggugcuacauccacuucuuccgcgagcccacggaccugaagcaguucaagcaggacgccaaguacagccacggcaucgacaucggggaccuguucgccgcgcagcccggccucaccuccgccgugaucgaggcccugccgcggaacauggugaucacgugccagggcagcgaggacaucaagcgccugcucgagucccaggggcggcgcgacauccggcuggucgacaucagccuguccaaggccgacagccgcaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgggcggugcugcccaaggacauggucuuccgcaccuccacgccccggguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5197 - RNA, 1927 nt, Artificial Sequence
  mRNA product Design1 comprising derived and/or modified sequence from Lassa virus__ANH09741__NP (opt1)
gggagaaagcuuaccaugagcaacuccaaggaggugaaguccuuccuguggacccagagccuccgccgggagcugagcggcuacugcaccaacaucaagcugcaggucgugaaggacgcccaggcccuccugcacgggcuggacuucuccgaggugagcaacguccagcgccucaugcggaagcagaagcgcgacgacaacgaccugaagcggcugcgcgaccucaaccaggcggugaacaaccugguggagcugaaguccguccagcagaaguccgugcucaaggugggcacgcugaacagcgacgaccugcucacccuggccgccgaccuggagaagcucaagagcaaggucgugcggaccgagcgcccccuguccagcgggguguacaugggcaaccuguccagccagcagcucgaccagcggcgcgcccugcugaacaugaucgggauggccggcggcucccaggggaaccagccgagccgggacggcgucgugcgcgugugggacgucaagaacgcggaccuccugaacaaccaguucgggaccaugcccucccugacgcucgccugccugaccaagcagggccagguggaccugaacgacgugguccucgcccugaccgaccuggggcucaucuacaccgccaaguaccccaacagcuccgaccuggaccggcugagccagaaccaccccgugcucaacaugaucgacgugaacaagagcucccugaacaucagcggcuacaacuucucccugggcgcggccgucaaggccggggccugcaugcucgacggcgggaacaugcuggagacgaucaagaucagcccgcagaccguggacggcauccugaaguccauccucaaggugaagcgcgcccugggcauguucgucagcgacacccccggggagcggaaccccuacgagaacauccuguacaaggugugccucuccggcaacggguggcccuacaucgcgagccgcaccuccaucgucggccgggccugggagaacacggugguggaccuggagagcaacaagaaccagccgaaggucgggaacaacggcuccaacaagaugcugcagagcuccggcuucgccaccgggcucaccuacagccagcugaugacccugcgcgacuccaugcugcagcucgaccccacggccaagaccuggaucgacaucgagggccggcccgaggaccccguggagcuggcccuguuccagccgagcuccgggugcuacauccacuucuuccgcgagcccaccgaccucaagcaguucaagcaggacgcgaaguacagccacggcaucgacgugaacgaccuguucuccgcccagcccgggcugaccagcgccguccucgaggcccugccccggaacauggugcugacgugccagggcagcgacgacauccgcaagcuccuggacucccaggaccgcaaggacaucaagcugaucgacaucagccucuccaaggccgacgcgcggaaguucgagaacgacgugugggaccaguucaaggaccugugccacaugcacaccggcaucgucguggagaagaagaagaagggcgggaagcaggagaugaccccgcacugcgcccugcucgacugcaucauguucgacgccgccgugagcgggggccugaacguccccacccugcgcgccgugcuccccacggacaugguguuccggaccaucaccaccaaggucgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5198 - RNA, 1930 nt, Artificial Sequence
  mRNA product Design1 comprising derived and/or modified sequence from Lassa virus__CAA36646__NP (opt1)
gggagaaagcuuaccaugagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagaagcgggacgacggcgaccugaagcgccugcgggaccucaaccaggccgugaacaaccugguggagcucaagagcacccagcagaaguccguccugcgcguggggacccugagcuccgacgaccugcucauccuggccgccgaccuggagaagcucaagagcaaggugacccggaccgagcgcccccuguccagcggcgucuacauggggaaccuguccagccagcagcucgaccagcggcgcgcccugcugaacaugaucggcaugaccggcguguccgggggcgggaagggcgcgagcgacgggaucgugcgggucugggacgugaagaacgccgagcuccugaacaaccaguucggcacgaugccgucccugacccucgccugccugaccaagcagggccagguggaccugaacgacgccguccaggcgcucaccgaccuggggcugaucuacacggccaaguaccccaacagcagcgaccucgaccgccugucccagagccaccccauccugaacaugaucgacaccaagaaguccagccucaacaucuccggcuacaacuucagccugggggccgccgugaaggccggcgcgugcaugcuggacggcgggaacaugcucgagaccaucaaggugagcccccagaccauggacggcauccucaaguccauccugaaggucaagaagucccuggggauguucgugagcgacacgccgggcgagcggaaccccuacgagaacauccuguacaagaucugccuguccggggacggcuggcccuacaucgccagccgcaccuccaucgugggccgggccugggagaacaccgucguggaccucgagcaggacaacaagccccagaagaucgggaacggcgggagcaacaagucccugcagagcgccggcuucgccgcggggcugaccuacucccagcucaugacgcugaaggacuucaagugcuucaaccugaucccgaacgccaagaccuggauggacaucgagggccgccccgaggaccccguggagaucgcccuguaccagcccagcuccggcugcuacguccacuucuuccgggagccgaccgaccucaagcaguucaagcaggacgccaaguacagccacgggaucgacgugaccgaccuguucgccgcgcagcccggccugacgagcgccgucaucgaggcccucccccgcaacauggugaucacgugccagggguccgaggacauccggaagcugcuggagagccagggccgccgcgacaucaagcucaucgacaucacccuguccaaggccgacagccggaaguucgagaacgccgugugggaccaguucaaggaccugugccacaugcacaccggggucgugguggagaagaagaagcgcggcggcaaggaggagaucacgccccacugcgcgcucauggacugcaucauguucgacgccgccgucuccgggggccuggacgccaaggugcugcgggugguccucccgcgcgacaugguguuccggaccagcacccccaaggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5199 - RNA, 1927 nt, Artificial Sequence
  mRNA product Design1 comprising derived and/or modified sequence from Lassa virus__CCA30315__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacagcgaccugaagcgccugcgggaccucaaccaggccgugaacaaccugguggagcugaaguccacccagcagaaguccguccuccgcgugggcacgcugagcagcgacgaccugcucacccuggccgccgaccuggagaagcucaaguccaaggugacccggaccgagcgcccccugagcuccggggucuacaugggcaaccugagcucccagcagcucgaccagcggcgcgcccugcugaaccucaucgggaugacgaacggcagccagggcucccaggcggggcgggacggcguggugcgcgucugggacgugaagaacgccgagcugcugaacaaccaguucgggaccaugccgagccucacccuggccugccugaccaagcagggccagguggaccucaacgacgucgugcaggcccugacggaccuggggcucaucuacaccgcgaaguaccccaacaccagcgaccuggaccggcugacccagucccaccccauccucaacaugaucgacacgaagaaguccagccugaacaucagcggcuacaacuucucccugggcgccgccgugaaggccggggccugcaugcucgacggcgggaacaugcuggagaccaucaaggucagcccccaguccauggacggcauccucaagagcauccugaaggugaagcgcgcgcugggcauguucguguccgacaccccgggggagcggaaccccuacgagaacauccuguacaagaucugccucagcggcgacggguggcccuacaucgccucccgcaccagcaucgucggccgggccugggagaacacggugguggaccuggagaccgacgggaagccccagaagaucggcuccggcaacagcaacaagucccugcagagcgccggguucuccgccggccucaccuacagccagcugaugacccugaaggacgcgaugcugcagcucgacccgaacgccaagacguggauggacaucgaggggcgccccgaggaccccgucgagguggcccuguaccagcccaucuccggcugcuacauccacuucuuccgggagccgaccgaccugaagcaguucaagcaggacgccaaguacagccacgggaucgacaucgccgaccucuucgcggcccagcccggccugaccagcgccgucaucgaggcccugccccgcaacauggugaucacgugccagggcuccgaggacaucaagaagcuccuggagagccaggggcgcaaggacaucaagcugaucgacaucgcccucuccaagaucgacagccggaaguucgagaacgcggugugggaccaguacaaggaccugugccacaugcacaccggcgucgugguggagaagaagaagcgcgggggcaaggaggagaucaccccgcacugcgcccugauggacugcaucauguucgacgccgccgucuccgggggccucaacacccuggugcugcgggcggugcucccccgcgacauggucuuccggaccagcacgccccgcguggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5200 - RNA, 1927 nt, Artificial Sequence
  mRNA product Design1 comprising derived and/or modified sequence from Lassa virus__JX985061__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5201 - RNA, 1927 nt, Artificial Sequence
  mRNA product Design1 comprising derived and/or modified sequence from Lassa virus__NP_694869__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcaccaugccgagccugacgcucgcgugccugaccaagcaggggcaggucgaccugaacgacgccgugcaggcccucaccgaccugggccugaucuacaccgccaaguaccccaacacguccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagaccaucaaggucagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacgguggucgaccucgagagcgacggcaagccccagaaggccgacuccaacaacagcuccaagagccugcaguccgccggcuucaccgccgggcugaccuacagccagcucaugacccugaaggacgccaugcugcagcuggacccgaacgcgaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgugaccgaccuguucgccacccagcccgggcucacgagcgccgucaucgacgcgcugccccgcaacauggugaucacgugccagggcuccgacgacauccgcaagcugcucgagagccagggccggaaggacaucaagcugaucgacaucgcccugagcaagaccgacucccgcaaguacgagaacgccgugugggaccaguacaaggaccucugccacaugcacaccggggucguggucgagaagaagaagcggggcgggaaggaggagaucaccccgcacugcgcccugauggacugcaucauguucgacgcggccgugagcggcgggcugaacaccuccgugcuccgcgccguccugccccgggacaugguguuccgcaccagcacgccccgggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5202 - RNA, 1927 nt, Artificial Sequence
  mRNA product Design1 comprising derived and/or modified sequence from Lassa virus__SCA79106__NP (opt1)
gggagaaagcuuaccaugagcaacuccaaggaggugaaguccuuccuguggacccagagccuccgccgggagcugagcggcuacugcuccaacaucaagcugcaggucgugaaggacgcccaggcccuccugcacgggcuggacuucagcgagguguccaacguccagcgccucaugcggaagcagaagcgcgacgacggcgaccugaagcggcugcgcgaccucaaccaggcggugaacaaccugguggagcucaagagcguccagcagaaguccauccugcggguggggacccugaccagcgacgaccugcucacccuggccgccgaccuggagaagcucaaguccaaggugacccgcaccgagcggccccugagcuccggcgucuacauggggaaccugagcucccagcagcucgaccagcgccgggcccugcugagcaugaucggcauguccggcgggaaccagaacagccagccgaagggcgacgggguggugcgcgucugggacgugaagaacgccgaccuccugaacaaccaguucggcacgaugcccucccugacccucgcgugccugaccaagcagggccagguggaccugaacgacgccguccaggcccucaccgaccuggggcugaucuacacggccaaguaccccaacagcagcgaccucgaccggcugucccagagccaccccauccugaacaugaucgacaccaagaaguccagccucaacaucuccggcuacaacuucagccugggggcggccaucaagaccggcgccugcaugcuggacgggggcaacaugcucgagaccaucaaggugacgccgcagaccauggacggcauccugaaguccauccugaaggugaagcgcagccucgggauguucaucuccgacacccccggcgagcggaaccccuacgagaacauccuguacaagaucugccugagcggggacggcuggcccuacaucgccucccgcaccgccaucaucgggcgggcgugggagaacacggucguggaccucgagagcgacuccaagccgcagaagaucggcagcaacggcuccaacaagagccugcaguccgccggguucgcccccggccugaccuacagccagcucaugacccugaaggacuccaugcugcagcuggaccccaacgccaagaccuggaucgacaucgaggggcgccccgaggacccgguggaggucgcccucuuccagcccaucagcggcugcuacauccacuucuuccgggagcccacggaccugaagcaguucaagcaggacgcgaaguacagccacgggaucgacgugaccgaccuguucgccgcccagcccggccucaccuccgccgugaucgaggcccugccgcgcaacaugguccugaccugccagggcagcgacgacaucaagaagcuccuggacucccaggggcggcgcgacaucaagcugaucgacgugagccucaacaagaucgacucccgcaaguucgagaacgcggucugggaccaguacaaggaccugugccacaugcacacgggcgugguggucgagaagaagaagaagggcgggaaggaggagaucacgccccacugcgcccugcucgacugcaucauguucgacgccgccgugagcgggggccugaacgccaccgugcugcgggcgguccucccccgcgacaugguguuccggaccuccagccccaaggugguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5203 - RNA, 517 nt, Artificial Sequence
  mRNA product Design1 comprising derived and/or modified sequence from Lassa virus__ADY11072__Z (opt1)
gggagaaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccgcugcccacgaagcuccgccccagcgccgcccccaccgccccgcccaccggggcggccgacuccauccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5204 - RNA, 517 nt, Artificial Sequence
  mRNA product Design1 comprising derived and/or modified sequence from Lassa virus__AAO59514__Z (opt1)
gggagaaagcuuaccaugggcaacaagcagguccgcagcaugaagaagguggacagcccccgggccucccugauccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugccgaccaagcucaagaccuccacgacccccaccgcgcccagcauccgcgaggccaacaccacgagcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5205 - RNA, 517 nt, Artificial Sequence
  mRNA product Design1 comprising derived and/or modified sequence from Lassa virus__AAO59508__Z (opt1)
gggagaaagcuuaccaugggcaaccgccaggccaagaaccccgagguggagaacagcccccgggccucccugauccccgacgcgacccaccucgggccccaguucugcaagagcugcugguucgagaacaagggccuggucgagugcaacaaccacuaccugugccucaacugccugucccugcuccugagcguguccaaccgcugccccaucugcaagaugccgcugcccacccggcuccgccccacgaccacccccaccgccccgcagaucaucaaggagaacacgaccaacccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5206 - RNA, 517 nt, Artificial Sequence
  mRNA product Design1 comprising derived and/or modified sequence from Lassa virus__AAO59510__Z (opt1)
gggagaaagcuuaccaugggcaacaagcagaccaaggcccccgaggccaaggacagcccgcgcgcgucccugauccccgacgccaccuaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgcgggggccgcccacagcgcccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5207 - RNA, 517 nt, Artificial Sequence
  mRNA product Design1 comprising derived and/or modified sequence from Lassa virus__AAT48997__Z (opt1)
gggagaaagcuuaccaugggcaacaagcaggccaaggcccccgagaccaagaacagcccccgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgugcccaccgccccgcccgcccaggugggggaccggacccgcccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5208 - RNA, 517 nt, Artificial Sequence
  mRNA product Design1 comprising derived and/or modified sequence from Lassa virus__AAT49005__Z (opt1)
gggagaaagcuuaccaugggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccacccgccuccggcccuccgccgugcccaccgccccgcccgcccccgcgggggaccgcaccaagcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5209 - RNA, 517 nt, Artificial Sequence
  mRNA product Design1 comprising derived and/or modified sequence from Lassa virus__ADU56612__Z (opt1)
gggagaaagcuuaccaugggcaaccgccagacccggcccaccgaggccacggagcagagccgcgcccaccuggugccggacgccucccaccucgggccccaguucugcaagagcugcugguucgagaaccggggccuggucgagugcaacaaccacuaccugugccucaacugccugucccugcuccugagcguguccagccgcugccccaucugcaagaugccccugccgacccggcucaaggccuccgcccagcccagcgccccgcccaccgaggcgccccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5210 - RNA, 517 nt, Artificial Sequence
  mRNA product Design1 comprising derived and/or modified sequence from Lassa virus__ADU56616__Z (opt1)
gggagaaagcuuaccaugggcgggaagcacaccaagcagccccgcgagagcaacuccccgcgggccagccugauccccgacgccacccaccucggcccccaguucugcaaguccugcugguucgagaacaaggggcugguggagugcaacaaccacuaccugugccucaacugccugagccugcuccuguccgucagcaaccgcugccccaucugcaagaugccccugcccacgcggcuccgcaccuccaccaaccccaccgcgccccagguggagcagacgggcccggccagcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5211 - RNA, 517 nt, Artificial Sequence
  mRNA product Design1 comprising derived and/or modified sequence from Lassa virus__ADU56620__Z (opt1)
gggagaaagcuuaccaugggcgggaagcacaccaagccccagcgcgagagcaacuccccgcgggccagccugauccccgacgccacccaccucggcccccaguucugcaaguccugcugguucgagaacaaggggcugguggagugcaacaaccacuaccugugccucaacugccugacgcugcuccugagcguguccaaccgcugccccaucugcaagaugccccugcccacccggcuccgcgccagcaccaaccccaccgcgccccagguggagcaggucggcccgacgaacccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5212 - RNA, 517 nt, Artificial Sequence
  mRNA product Design1 comprising derived and/or modified sequence from Lassa virus__ADU56624__Z (opt1)
gggagaaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5213 - RNA, 517 nt, Artificial Sequence
  mRNA product Design1 comprising derived and/or modified sequence from Lassa virus__ADU56628__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5214 - RNA, 517 nt, Artificial Sequence
  mRNA product Design1 comprising derived and/or modified sequence from Lassa virus__ADU56632__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgacccaggacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5215 - RNA, 517 nt, Artificial Sequence
  mRNA product Design1 comprising derived and/or modified sequence from Lassa virus__ADU56644__Z (opt1)
gggagaaagcuuaccaugggcaaccgccagaccaaggcccccgaggccaaggggagcccccgggcgucccugauccccgacgccacccaccucggcccccaguucugcaagagcugcugguucgagaacaaggggcugguggagugcaacgaccacuaccugugccucaacugccugacgcugcuccuguccgucagcucccgcugccccaucugcaagaugccgcugcccacccggcuccgccccagcaccaaccccaccgccccgcccgcccgggccgagggcgggaucaacccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5216 - RNA, 517 nt, Artificial Sequence
  mRNA product Design1 comprising derived and/or modified sequence from Lassa virus__AHC95545__Z (opt1)
gggagaaagcuuaccaugggcaacaagcaggccaaggaccccaagaccgagagcuccccgcgcgccagccugauccccgacgcgacccaccucgggccccaguucugcaaguccugcugguucgagaacaagggccugguggagugcaacaaccacuaccugugccucaacugccugagccugcuccuguccgucagcaaccggugccccaucugcaagaugccccugcccacgaagcucaagcccaucaccacccccaccgccccgcagaucacgcgcgaguccaucaccaacccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5217 - RNA, 517 nt, Artificial Sequence
  mRNA product Design1 comprising derived and/or modified sequence from Lassa virus__AHC95547__Z (opt1)
gggagaaagcuuaccaugggcaaccgccaggccaaggaccccaagguggagagcuccccgcgggccagccugauccccgacgcgacccaccucgggccccaguucugcaaguccugcugguucgagaacaagggccuggucgagugcaacaaccacuaccugugccucaacugccugagccugcuccuguccgugagcaaccgcugccccaucugcaagaugccccugcccacccggcuccgccccacgaccaugcccaccgccccgcagaucaucaaggaggggaccacgaacccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5218 - RNA, 517 nt, Artificial Sequence
  mRNA product Design1 comprising derived and/or modified sequence from Lassa virus__AIT17124__Z (opt1)
gggagaaagcuuaccaugggcaacaagcaggucaagacccccgaggccaaggacagcccccgcgccucccugauccccgacgcgacccaccucgggccccaguucugcaagagcugcugguucgagaacaagggccugguggagugcaacaaccacuaccugugccucaacugccugacgcugcuccuguccguggggaaccggugccccaucugcaagaugccgcugcccaccaagcuccgccccagcgugacccccaccgccccgcccacgcgggccgccgacuccaucggcccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5219 - RNA, 517 nt, Artificial Sequence
  mRNA product Design1 comprising derived and/or modified sequence from Lassa virus__AIT17128__Z (opt1)
gggagaaagcuuaccaugggcaacaagcaggccaagacccccgaggccaaggacagcccgcgcgcgaaccugauccccgacgccacccaccucgggccccaguucugcaaguccugcugguucgagaacaagggccugguggagugcaacaaccacuaccugugccucaacugccugacgcugcuccugagcgucuccaaccggugccccaucugcaagaugccgcugcccaccaagcuccgccccagcgccgcccccaccgccccgcccaccggggcggccgacuccauccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5220 - RNA, 517 nt, Artificial Sequence
  mRNA product Design1 comprising derived and/or modified sequence from Lassa virus__AIT17132__Z (opt1)
gggagaaagcuuaccaugggcaacaagcaggccaaggcccccgaggcgcgcgacagcccccgggccucccugauccccgacgccacccaccucgggccccaguucugcaagagcugcugguucgagaacaagggccugguggagugcaacaaccacuaccugugccucaacugccugacccugcuccuguccgucagcaaccgcugccccaucugcaagaugccgcugcccacgaagcuccggcccuccgccacccccaccgccccgcccaccgaggcggccgacagcauccgcccgccgcccuaccggcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5221 - RNA, 517 nt, Artificial Sequence
  mRNA product Design1 comprising derived and/or modified sequence from Lassa virus__AIT17136__Z (opt1)
gggagaaagcuuaccaugggcaacaagcagaccaaggcccccgagagcaagaacuccccgcgcgccagccugauccccgacgcgaccuaccucgggccccaguucugcaaguccugcugguucgagaacaagggccugguggagugcaacaaccacuaccugugccucaacugccugacgcugcuccugagcgucuccaaccggugccccaucugcaagaugccgcugcccaccaagcuccgcagcuccgccgcccccaccgcgcccccgaccggggccgccgacagcacgaagcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5222 - RNA, 517 nt, Artificial Sequence
  mRNA product Design1 comprising derived and/or modified sequence from Lassa virus__AIT17140__Z (opt1)
gggagaaagcuuaccaugggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccgccgccccgaccgccccgcccgcgggggccguggacagcacccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5223 - RNA, 517 nt, Artificial Sequence
  mRNA product Design1 comprising derived and/or modified sequence from Lassa virus__AIT17144__Z (opt1)
gggagaaagcuuaccaugggcaacaagcaggccaagacccccgagagcaaggacuccccgcgcgccagccugauccccgacgccacccaccucgggccccaguucugcaaguccugcugguucgagaacaagggccugguggagugcaacaaccacuaccugugccucaacugccugacgcugcuccugggggucagcaaccggugccccaucugcaagaugccgcugcccaccaagcuccgcuccagcguggcccccaccgcgcccccgaccggcgccguggacuccauccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5224 - RNA, 517 nt, Artificial Sequence
  mRNA product Design1 comprising derived and/or modified sequence from Lassa virus__AIT17152__Z (opt1)
gggagaaagcuuaccaugggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccaccgcccccacggccccgcccgccggggccgcggacaacacccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5225 - RNA, 517 nt, Artificial Sequence
  mRNA product Design1 comprising derived and/or modified sequence from Lassa virus__AIT17162__Z (opt1)
gggagaaagcuuaccaugggcaacaagcaggccaaggccagcgaguccaaggacagcccccgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccccugccgacgaagcuccgccccuccgugacccccaccgcgcccccgacccggacggccgacaacacccgcccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5226 - RNA, 517 nt, Artificial Sequence
  mRNA product Design1 comprising derived and/or modified sequence from Lassa virus__AIT17166__Z (opt1)
gggagaaagcuuaccaugggcaacaagcaggccaaggcccccgaggcgaaggacagcccgcgcgccucccugauccccgacgccacccaccucgggccccaguucugcaagagcugcugguucgagaccaagggccugguggagugcaacaaccacuaccugugccucaacugccugacgcugcuccuguccgucagcaaccggugccccaucugcaagaugccgcugcccaccaagcuccgccccuccgccacccccaccgccccgcccacggaggcggccgacagcaucgggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5227 - RNA, 517 nt, Artificial Sequence
  mRNA product Design1 comprising derived and/or modified sequence from Lassa virus__AIT17170__Z (opt1)
gggagaaagcuuaccaugggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccggugccccaucugcaagaugccgcugcccacgaagcuccgccccagcgccgcccccaccgccccgcccgccggggcggccgacuccauccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5228 - RNA, 517 nt, Artificial Sequence
  mRNA product Design1 comprising derived and/or modified sequence from Lassa virus__AIT17174__Z (opt1)
gggagaaagcuuaccaugggcaacaagcagaccaaggcccccgaggccaaggggagcccgcgcgcgucccugauccccgacgccacccaccucggcccccaguucugcaagagcugcugguucgagaacaaggggcugguggagugcaacaaccacuaccugugccucaacugccugacgcugcuccuguccgucagcucccggugccccaucugcaagaugccgcugcccaccaagcuccgccccagcgccgugcccaccgccccgcccaccaaggccgaggacaacacgcggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5229 - RNA, 517 nt, Artificial Sequence
  mRNA product Design1 comprising derived and/or modified sequence from Lassa virus__AIT17178__Z (opt1)
gggagaaagcuuaccaugggcaacaagcaggccaaggccagcgaggcgaaggacagcccccgcgccucccugaucccggacgccacccaccucgggccccaguucugcaaguccugcugguucgagaacaagggccugguggagugcaacaaccacuaccugugccucaacugccugagccugcuccuguccgucagcucccggugccccaucugcaagaugccccugccgacccgccuccggcccagcacggcccccaccgcgcccccggcccgcgccggggacaacaucaagcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5230 - RNA, 517 nt, Artificial Sequence
  mRNA product Design1 comprising derived and/or modified sequence from Lassa virus__AIT17182__Z (opt1)
gggagaaagcuuaccaugggcaacaagcaggccaaggugcccgagguccgcgacagcccccgggccucccugauccccgacgcgacccaccucgggccccaguucugcaagagcugcugguucgagaacaagggccugguggagugcaacaaccacuaccugugccucaacugccugacccugcuccuguccgugagcucccgcugccccaucugcaagaugccgcugcccacgaagcuccggcccagcgccacccccaccgccccgcccgccggggccggcgacgggacccgcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5231 - RNA, 517 nt, Artificial Sequence
  mRNA product Design1 comprising derived and/or modified sequence from Lassa virus__AIT17186__Z (opt1)
gggagaaagcuuaccaugggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccguggcccccaccgccccgcccgccggggccgcggacaacacgcggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5232 - RNA, 517 nt, Artificial Sequence
  mRNA product Design1 comprising derived and/or modified sequence from Lassa virus__AIT17194__Z (opt1)
gggagaaagcuuaccaugggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccguggccccgaccgccccgcccgccgggguggucgacagcacccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5233 - RNA, 517 nt, Artificial Sequence
  mRNA product Design1 comprising derived and/or modified sequence from Lassa virus__AIT17198__Z (opt1)
gggagaaagcuuaccaugggcaacaagcaggccaaggugcccgagagcaaggacuccccgcgcgccagccugauccccgacgcgacccaccucgggccccaguucugcaaguccugcugguucgagaaccgcggccuggucgagugcaacaaccacuaccugugccucaacugccugacccugcuccugagcguguccaaccgcugccccaucugcaagaugccgcugcccacgaagcuccggcccagcaccgcccccaccgccccgcccaccggggccgccgacuccacgcggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5234 - RNA, 517 nt, Artificial Sequence
  mRNA product Design1 comprising derived and/or modified sequence from Lassa virus__AIT17202__Z (opt1)
gggagaaagcuuaccaugggcaacaagcaggccaagacccccgagagcaaggacuccccgcgcgccagccugauccccgacgcgacccaccucgggccccaguucugcaaguccugcugguucgagaacaagggccugguggagugcaacaaccacuaccugugccucaacugccugacgcugcuccugagcgucuccaaccgcugccccaucugcaagaugccgcugcccacccgccuccggcccagcgccgcccccaccgccccgcccuccggggccgcggacagcacccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5235 - RNA, 517 nt, Artificial Sequence
  mRNA product Design1 comprising derived and/or modified sequence from Lassa virus__AIT17206__Z (opt1)
gggagaaagcuuaccaugggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcuaccggugccccaucugcaagaugccgcugcccacgaagcuccgccccuccgccacccccaccgccccgcccaccgaggcggccgacagcauccggcccccgcccuaccgccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5236 - RNA, 517 nt, Artificial Sequence
  mRNA product Design1 comprising derived and/or modified sequence from Lassa virus__AIT17214__Z (opt1)
gggagaaagcuuaccaugggcaacaagcaggccaaggcccccgaggugaaggacagcccgcgcgcgucccugauccccgacgccacccaccucgggccccaguucugcaagagcugcugguucgagaacaagggccuggucgagugcaacaaccacuaccugugccucaacugccugacccugcuccuguccgugagcaaccggugccccaucugcaagaugccgcugcccacgaagcuccgccccuccgccgcccccaccgccccgcccaccgggaccgcggacagcauccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5237 - RNA, 517 nt, Artificial Sequence
  mRNA product Design1 comprising derived and/or modified sequence from Lassa virus__AIT17222__Z (opt1)
gggagaaagcuuaccaugggcaacaagcaggccaagacccccgagaccaaggacagcccccgcgccucccugauccccgacgcgacgcaccucgggccccaguucugcaagagcugcugguucgagaacaagggccugguggagugcaacucccacuaccugugccucaacugccugacccugcuccugagcgucuccagccggugccccaucugcaagaugccgcugcccacccgccuccggcccuccaccgcccccacggccccgcccgccggggugggcgacagcaccuccccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5238 - RNA, 517 nt, Artificial Sequence
  mRNA product Design1 comprising derived and/or modified sequence from Lassa virus__AIT17226__Z (opt1)
gggagaaagcuuaccaugggcaacaagcaggccaagacccccgaggccaaggacagcccccgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccacccccaccgccccgcccgccggggcggccgacagcaucggcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5239 - RNA, 514 nt, Artificial Sequence
  mRNA product Design1 comprising derived and/or modified sequence from Lassa virus__AIT17230__Z (opt1)
gggagaaagcuuaccaugggcaacaagcaggccaaggccagcgacaagaacagcccccgcgcgucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcgccacccccaccgcgcccccgaccggggccgccgacuccauccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5240 - RNA, 517 nt, Artificial Sequence
  mRNA product Design1 comprising derived and/or modified sequence from Lassa virus__AIT17234__Z (opt1)
gggagaaagcuuaccaugggcaacaagcaggccaaggccagcgaggagaagaacagcccccgcgcgucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcgccacccccaccgcgcccccgaccggggccgccgacuccauccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5241 - RNA, 517 nt, Artificial Sequence
  mRNA product Design1 comprising derived and/or modified sequence from Lassa virus__AIT17238__Z (opt1)
gggagaaagcuuaccaugggcaacaagcagaccaaggcccccgaggccaaggggagcccgcgcgcgucccugauccccgacgccacccaccucggcccccaguucugcaagagcugcugguucgagaacaaggggcugguggagugcaacaaccacuaccugugccucaacugccugacgcugcuccuguccgucagcaaccggugccccaucugcaagaugccgcugcccaccaagcuccgccccuccgccacccccaccgccccgcccacggaggccgcggacagcauccggcccccgcccuaccgccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5242 - RNA, 517 nt, Artificial Sequence
  mRNA product Design1 comprising derived and/or modified sequence from Lassa virus__AIT17242__Z (opt1)
gggagaaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgcgccuccggcccagcgccgcccccaccgccccgcccaccggggcgaccgacuccacgcggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5243 - RNA, 517 nt, Artificial Sequence
  mRNA product Design1 comprising derived and/or modified sequence from Lassa virus__AIT17248__Z (opt1)
gggagaaagcuuaccaugggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagacgccgcugcccacccggcuccgccccuccgccacccccaccgccccgcccgccggcgcgggggacaacacgcggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5244 - RNA, 517 nt, Artificial Sequence
  mRNA product Design1 comprising derived and/or modified sequence from Lassa virus__AIT17252__Z (opt1)
gggagaaagcuuaccaugggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccgcugcccacgaagcuccgccccuccaccgcccccaccgccccgcccgcgggggccgccgacagcacccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5245 - RNA, 517 nt, Artificial Sequence
  mRNA product Design1 comprising derived and/or modified sequence from Lassa virus__AIT17256__Z (opt1)
gggagaaagcuuaccaugggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgugggggcggccgacaacacccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5246 - RNA, 517 nt, Artificial Sequence
  mRNA product Design1 comprising derived and/or modified sequence from Lassa virus__AIT17260__Z (opt1)
gggagaaagcuuaccaugggcaacaagcaggccaaggcccccgagcugaaggacagcccgcgcgcgucccucauccccgacgccacccaccuggggccccaguucugcaagagcugcugguucgagaacaagggccugguggagugcaacaaccacuaccucugccugaacugccugacccuccugcuguccgucagcaaccggugccccaucugcaagaugccgcuccccacgaagcugcgccccuccgccgcccccaccgccccgcccgcgggggccguggacagcacccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5247 - RNA, 517 nt, Artificial Sequence
  mRNA product Design1 comprising derived and/or modified sequence from Lassa virus__AIT17268__Z (opt1)
gggagaaagcuuaccaugggcaacaagcagaccaaggcccccgaggugaaggggagcccccgcgccucccugauccccgacgcgacccaccucggcccccaguucugcaagagcugcugguucgagaacaaggggcuggucgagugcaacaaccacuaccugugccucaacugccugacgcugcuccuguccgugagcaaccggugccccaucugcaagaugccgcugcccaccaagcucaagcccuccaccacccccacggccccgcccaccggcgccgccgacagcauccgcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5248 - RNA, 517 nt, Artificial Sequence
  mRNA product Design1 comprising derived and/or modified sequence from Lassa virus__AIT17272__Z (opt1)
gggagaaagcuuaccaugggcaacaagcaggucaagaccagcgaggcccgcgacagcccccgggccucccugaucccggacgccaccgaccucgggccccaguucugcaaguccugcugguucgagaacaagggccugguggagugcaacaaccacuaccugugccucaacugccugacgcugcuccugagcguguccaaccgcugccccaucugcaagaugccccugccgacccggcuccgccccagcgccaaccccaccgcgcccccggccgagaccggggacuccacgcggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5249 - RNA, 517 nt, Artificial Sequence
  mRNA product Design1 comprising derived and/or modified sequence from Lassa virus__AIT17278__Z (opt1)
gggagaaagcuuaccaugggcagcaagcagaccaagacccccgaggugaaggacuccccgcgcgccagccugauccccgacgccacgcaccucgggccccaguucugcaaguccugcugguucgagaacaagggccuggucgagugcaacaaccacuaccugugccucaacugccugacccugcuccugagcguguccaaccgcugccccaucugcaagaugccgcugcccaccaagcuccgccccagcgcggcccccaccgccccgcccgcccgggccgcggacgacacgcggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5250 - RNA, 517 nt, Artificial Sequence
  mRNA product Design1 comprising derived and/or modified sequence from Lassa virus__AIT17282__Z (opt1)
gggagaaagcuuaccaugggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccgccgccccgaccgccccgcccgcgggggccguggacagcauccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5251 - RNA, 517 nt, Artificial Sequence
  mRNA product Design1 comprising derived and/or modified sequence from Lassa virus__AIT17286__Z (opt1)
gggagaaagcuuaccaugggcaacaagcagaccaaggcccccgaggugaaggacagcccgcgcgccucccugauccccgacgcgacccaccucgggccccaguucugcaagagcugcugguucgagaacaagggccuggucgagugcaacaaccacuaccugugccucaacugccugacgcugcuccuguccgugagcaaccggugccccaucugcaagaugccgcugcccaccaagcuccgccccuccaccgcccccaccgccccgcccgccgggacgauggacagcacccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5252 - RNA, 517 nt, Artificial Sequence
  mRNA product Design1 comprising derived and/or modified sequence from Lassa virus__AIT17290__Z (opt1)
gggagaaagcuuaccaugggcaacaagcaggcccgcgcccccgaggcgaaggacagcccgcgggccucccugauccccgacgccacccaccucgggccccaguucugcaagagcugcugguucgagaacaagggccugguggagugcaacaaccacuaccugugccucaacugccugacccugcuccuguccgucagcucccgcugccccaucugcaagaugccgcugcccacgcggcuccgccccagcgccauccccaccgccccgcccgcggggaccggcgacuccagccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5253 - RNA, 517 nt, Artificial Sequence
  mRNA product Design1 comprising derived and/or modified sequence from Lassa virus__AIT17296__Z (opt1)
gggagaaagcuuaccaugggcaacaagcaggccaagacccccgagaucaaggacagcccgcgcgccucccugauccccgacgcgacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgccggggcggccgacaucacccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5254 - RNA, 517 nt, Artificial Sequence
  mRNA product Design1 comprising derived and/or modified sequence from Lassa virus__AIT17300__Z (opt1)
gggagaaagcuuaccaugggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagaugccgcugcccacgcggcuccgccccuccaccgcccccaccgccccgcccgccggcgcgggggacaacacccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5255 - RNA, 517 nt, Artificial Sequence
  mRNA product Design1 comprising derived and/or modified sequence from Lassa virus__AIT17312__Z (opt1)
gggagaaagcuuaccaugggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccgccgcccccaccgccccgcccgugggggccgcggacagcacgcggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5256 - RNA, 517 nt, Artificial Sequence
  mRNA product Design1 comprising derived and/or modified sequence from Lassa virus__AIT17316__Z (opt1)
gggagaaagcuuaccaugggcaacaagcaggccaaggcccccgaggcgcgcaacagcccccgggccucccugauccccgacgccacccaccucgggccccaguucugcaagagcugcugguucgagaaccgcggccugguggagugcaacaaccacuaccugugccucaacugccugacccugcuccuguccgucagcucccggugccccaucugcaagaugccgcugcccacgcgccuccggcccagcgccgcccccaccgcgccgcccgccggggccggcgacaacacccgcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5257 - RNA, 517 nt, Artificial Sequence
  mRNA product Design1 comprising derived and/or modified sequence from Lassa virus__AIT17320__Z (opt1)
gggagaaagcuuaccaugggcaacaagcaggccaaggcccccgaggcgcgcaacagcccgcgggccucccugauccccgacgccacccaccucgggccccaguucugcaagagcugcugguucgagaacaagggccugguggagugcaacaaccacuaccugugccucaacugccugacccugcuccugggggucuccagccgcugccccaucugcaagaugccgcugcccacgcggcuccgccccuccgccgcccccaccgcgccgcuggccgaggccggcgacaacacccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5258 - RNA, 517 nt, Artificial Sequence
  mRNA product Design1 comprising derived and/or modified sequence from Lassa virus__AIT17326__Z (opt1)
gggagaaagcuuaccaugggcaacaagcagagcaaggcccccgagucccgcgacagcccgcgggccucccugauccccgacgcgacccaccucgggccccaguucugcaagagcugcugguucgagaacaagggccugguggagugcaacaaccacuaccugugccucaacugccugacccugcuccuguccgucagcaaccgcugccccaucugcaagaugccgcugcccacgaagcuccggcccuccgccacccccaccgccccgcccacccgcgccgccgacagcauccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5259 - RNA, 517 nt, Artificial Sequence
  mRNA product Design1 comprising derived and/or modified sequence from Lassa virus__AIT17330__Z (opt1)
gggagaaagcuuaccaugggcaacaagcaggccaaggcccuggagagcaagaacagcccccgcgcgucccucauccccgacgccaccuaccuggggccccaguucugcaaguccugcugguucgagaacaagggccugguggagugcaacaaccacuaccucugccugaacugccugacccuccugcugagcgucuccaaccggugccccaucugcaagaugccccucccgacgaagcugcgcagcuccgccgcccccaccgccccgcccaccggggcggccgacggcaccaagcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5260 - RNA, 517 nt, Artificial Sequence
  mRNA product Design1 comprising derived and/or modified sequence from Lassa virus__AIT17342__Z (opt1)
gggagaaagcuuaccaugggcaacaagcaggccaaggccagcgaggcgaaggacagcccccgcgccucccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcaccgcccccaccgcgccccagaccggggccgccgacuccauccggccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5261 - RNA, 517 nt, Artificial Sequence
  mRNA product Design1 comprising derived and/or modified sequence from Lassa virus__AIT17346__Z (opt1)
gggagaaagcuuaccaugggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgugggggcggccgacagcacccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5262 - RNA, 517 nt, Artificial Sequence
  mRNA product Design1 comprising derived and/or modified sequence from Lassa virus__AIT17362__Z (opt1)
gggagaaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccgcugcccacgaagcuccgccccagcgccgcccccaccgccccgcccgcgggggccgccgacuccauccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5263 - RNA, 517 nt, Artificial Sequence
  mRNA product Design1 comprising derived and/or modified sequence from Lassa virus__AIT17366__Z (opt1)
gggagaaagcuuaccaugggcaacaagcagaccaagacccccgaggugaaggacagcccccgcgccucccugauccccgacgccacgcaccucgggccccaguucugcaagagcugcugguucgagaacaagggccuggucgagugcaacaaccacuaccugugccucaacugccugacccugcuccuguccgugagcaaccggugccccaucugcaagaugccgcugcccaccaagcuccgccccuccgcggcccccaccgccccgcccgcccgggccgcggacgacacgcgcccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5264 - RNA, 517 nt, Artificial Sequence
  mRNA product Design1 comprising derived and/or modified sequence from Lassa virus__AIT17376__Z (opt1)
gggagaaagcuuaccaugggcaacaagcaggccaaggcccccgagagcaaggacuccccgcgcgcgagccugauccccgacgccaccuaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgaagcuccgcagcuccguggcccccaccgcgcccccgacccgggccgccgacagcacccggcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5265 - RNA, 517 nt, Artificial Sequence
  mRNA product Design1 comprising derived and/or modified sequence from Lassa virus__AIT17382__Z (opt1)
gggagaaagcuuaccaugggcaacaagcagaccaagaccagcgaggugaaggacagcccccgcgccucccugauccccgacgccacgcaccucgggccccaguucugcaaguccugcugguucgagaacaagggccuggucgagugcaacaaccacuaccugugccucaacugccugacccugcuccugagcguguccaaccggugccccaucugcaagaugccccugccgaccaagcuccgccccagcgcggcccccaccgcgcccccggcccgggccgccgacgacacgcgcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5266 - RNA, 517 nt, Artificial Sequence
  mRNA product Design1 comprising derived and/or modified sequence from Lassa virus__AIT17386__Z (opt1)
gggagaaagcuuaccaugggcaacaagcaggccaagacccccgaggcccgcgacagcccccgggcgucccugauccccgacgccacccaccucgggccccaguucugcaagagcugcugguucgagaacaagggccugguggagugcaacaaccacuaccugugccucaacugccugacgcugcuccuguccgucagcucccgcugccccaucugcaagaugccgcugcccaccaagcuccggcccagcgccacccccaccgccccgcccgccggggcgggcgacgggacgcgcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5267 - RNA, 517 nt, Artificial Sequence
  mRNA product Design1 comprising derived and/or modified sequence from Lassa virus__AIT17396__Z (opt1)
gggagaaagcuuaccaugggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagaugccgcugcccacgcggcuccgccccuccgccgcccccaccgccccgcccgcggaggccggcgacaacacccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5268 - RNA, 517 nt, Artificial Sequence
  mRNA product Design1 comprising derived and/or modified sequence from Lassa virus__AIT17402__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggagaccauccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5269 - RNA, 517 nt, Artificial Sequence
  mRNA product Design1 comprising derived and/or modified sequence from Lassa virus__AIT17406__Z (opt1)
gggagaaagcuuaccaugggcaaccgccaggccaagagcuccaagguggacgagcaccagcgggcccaccugguccccgacgcgagccaccucgggccccaguucugcaaguccugcugguucgagaacaagggccugguggagugcaacaaccacuaccugugccucaacugccugagccugcuccuguccgugagcucccgcugccccaucugcaagaugccccugcccaccaagcucaaggccgccgcccagccgagcgcccccuccaccgaggcgguccagaacacggccccgccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5270 - RNA, 517 nt, Artificial Sequence
  mRNA product Design1 comprising derived and/or modified sequence from Lassa virus__AIT17410__Z (opt1)
gggagaaagcuuaccaugggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5271 - RNA, 517 nt, Artificial Sequence
  mRNA product Design1 comprising derived and/or modified sequence from Lassa virus__AIT17418__Z (opt1)
gggagaaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgagaccauccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5272 - RNA, 517 nt, Artificial Sequence
  mRNA product Design1 comprising derived and/or modified sequence from Lassa virus__AIT17422__Z (opt1)
gggagaaagcuuaccaugggcaaccgccaggccaagagcgccaagguggacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacccagccguccgcccccagcacggaggcgacccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5273 - RNA, 517 nt, Artificial Sequence
  mRNA product Design1 comprising derived and/or modified sequence from Lassa virus__AIT17426__Z (opt1)
gggagaaagcuuaccaugggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccacgcagccguccgcccccagcaccgaggccacccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5274 - RNA, 517 nt, Artificial Sequence
  mRNA product Design1 comprising derived and/or modified sequence from Lassa virus__AIT17432__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccaucccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5275 - RNA, 517 nt, Artificial Sequence
  mRNA product Design1 comprising derived and/or modified sequence from Lassa virus__AIT17436__Z (opt1)
gggagaaagcuuaccaugggcaacaagcaggccaagagcaccaaggccgacgagcaccagcgcgcgcaccuggugcccgacgccucccaccucgggccgcaguucugcaagagcugcugguucgagaaccggggccuggucgagugcaacaaccacuaccugugccucaacugccugucccugcuccugagcguguccagccgcugccccaucugcaagaugccccugcccaccaagcucaaggccgccacgcagccguccgcccccagcaccgaggcgacccggaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5276 - RNA, 517 nt, Artificial Sequence
  mRNA product Design1 comprising derived and/or modified sequence from Lassa virus__AIT17444__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccgccgcccagccguccgcccccagcacggaggcggcccagaacaccgccccgccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5277 - RNA, 517 nt, Artificial Sequence
  mRNA product Design1 comprising derived and/or modified sequence from Lassa virus__AIT17448__Z (opt1)
gggagaaagcuuaccaugggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccacggcccagccguccgcccccagcgccgaggcgauccagaacaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5278 - RNA, 517 nt, Artificial Sequence
  mRNA product Design1 comprising derived and/or modified sequence from Lassa virus__AIT17452__Z (opt1)
gggagaaagcuuaccaugggcaaccgccaggccaagagcacccggguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccacccggcuccgcgccgccguccagccguccgcccccagcacggagaccacccaggacaccacgcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5279 - RNA, 517 nt, Artificial Sequence
  mRNA product Design1 comprising derived and/or modified sequence from Lassa virus__AIT17456__Z (opt1)
gggagaaagcuuaccaugggcaaccgccaggccaagagcaccgaggugaacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccgugcccccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5280 - RNA, 517 nt, Artificial Sequence
  mRNA product Design1 comprising derived and/or modified sequence from Lassa virus__AIT17460__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagcccuccgccccgcccacggaggcgacccagaacaccacgccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5281 - RNA, 517 nt, Artificial Sequence
  mRNA product Design1 comprising derived and/or modified sequence from Lassa virus__AIT17468__Z (opt1)
gggagaaagcuuaccaugggcaaccgccaggccaagcagaccaagguggacgagcaccagcgggcccaccugguccccgacgcgagccaccucgggccccaguucugcaaguccugcugguucgagaaccgcggccugguggagugcaacaaccacuaccugugccucaacugccugagccugcuccuguccaucagcucccggugccccaucugcaagaugccccugcccaccaagcucaaggccgccgcccagccgagcgcccccuccacggaggcgacccaggacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5282 - RNA, 517 nt, Artificial Sequence
  mRNA product Design1 comprising derived and/or modified sequence from Lassa virus__AIT17472__Z (opt1)
gggagaaagcuuaccaugggcaacaagcagaccaagagcaccaaggccgacgagcaccagcgcgcccaccuggugcccgacgcgucccaccucgggccgcaguucugcaagagcugcugguucgagaaccggggccuggucgagugcaacaaccacuaccugugccucaacugccugucccugcuccugagcguguccagccgcugccccaucugcaagaugccccugcccacgcggcucaaggccgccgcccagccguccgcccccagcaccgaggcgacccaggacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5283 - RNA, 517 nt, Artificial Sequence
  mRNA product Design1 comprising derived and/or modified sequence from Lassa virus__AIT17476__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcgcggaggccauccagaacacgaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5284 - RNA, 517 nt, Artificial Sequence
  mRNA product Design1 comprising derived and/or modified sequence from Lassa virus__AIT17480__Z (opt1)
gggagaaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggucauccaguccaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5285 - RNA, 517 nt, Artificial Sequence
  mRNA product Design1 comprising derived and/or modified sequence from Lassa virus__AIT17484__Z (opt1)
gggagaaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggagauccagaacaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5286 - RNA, 517 nt, Artificial Sequence
  mRNA product Design1 comprising derived and/or modified sequence from Lassa virus__AIT17488__Z (opt1)
gggagaaagcuuaccaugggcaaccgccaggccaagcccaccaagguggacgagcaccagcgggcccaccuggucccggacgccagccaccucgggccccaguucugcaaguccugcugguucgagaacaagggccugguggagugcaacaaccacuaccugugccucaacugccugagccugcuccuguccgugagcucccgcugccccaucugcaagaugccccugccgaccaagcucaaggccgccgcccagcccagcgcccccuccacggaggcggcccagaacaccgcgcccccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5287 - RNA, 517 nt, Artificial Sequence
  mRNA product Design1 comprising derived and/or modified sequence from Lassa virus__AIT17496__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccacccgccucaaggccgccacgcagccguccgcccccagcaccgaggccacccagaccacgaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5288 - RNA, 517 nt, Artificial Sequence
  mRNA product Design1 comprising derived and/or modified sequence from Lassa virus__AIT17500__Z (opt1)
gggagaaagcuuaccaugggcaaccgccagaccaagagcaccaagguggacgagcaccagcgggcccaccugguccccgacgccucccaccucgggccccaguucugcaagagcugcugguucgagaacaagggccugguggagugcaacaaccacuaccugugccucaacugccugucccugcuccugagcguguccagccgcugccccaucugcaagaugccccugcccacgaagcucaagaccgcggcccagccguccgccccgcccaccgaggccgcccggaccacggcgcccccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5289 - RNA, 517 nt, Artificial Sequence
  mRNA product Design1 comprising derived and/or modified sequence from Lassa virus__AIT17508__Z (opt1)
gggagaaagcuuaccaugggcaaccgccagaccaagagcaccaagguggacgagcaccagcgggcccaccugguccccgacgccucccaccucgggccgcaguucugcaagagcugcugguucgagaacaagggccugguggagugcaacaaccacuaccugugccucaacugccugucccugcuccugagcguguccagccgcugccccaucugcaagaugccccugcccacgaagcucaaggcggccgcccagccguccgcccccagcaccgaggccacccagaacaccgcgcccccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5290 - RNA, 517 nt, Artificial Sequence
  mRNA product Design1 comprising derived and/or modified sequence from Lassa virus__AIT17512__Z (opt1)
gggagaaagcuuaccaugggcaaccgccaggccaagagcaccaagguguacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccacccgccucaaggccgccacgcagccguccgcccccagcaccgaggccacccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5291 - RNA, 517 nt, Artificial Sequence
  mRNA product Design1 comprising derived and/or modified sequence from Lassa virus__AIT17516__Z (opt1)
gggagaaagcuuaccaugggcaaccgccaggccaagagcaccaagguggacgagcaccagcgggcccaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaagacggccacccagccguccgcgccccugaccgaggccacccagaacacgaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5292 - RNA, 517 nt, Artificial Sequence
  mRNA product Design1 comprising derived and/or modified sequence from Lassa virus__AIT17520__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccaaccgcugccccaucugcaagaugccccugcccaccaagcucaaggccgccgcccagccgagcgcccccuccacggaggcgacccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5293 - RNA, 517 nt, Artificial Sequence
  mRNA product Design1 comprising derived and/or modified sequence from Lassa virus__AIT17526__Z (opt1)
gggagaaagcuuaccaugggcaaccgccaggccaagagcgccaaggugaccgagcaccagcgggcccaccugguccccgacgccucccaccucgggccgcaguucugcaagagcugcugguucgagaacaagggccugguggagugcaacaaccacuaccugugccucaacugccugucccugcuccugagcguguccagccgcugccccaucugcaagaugccccugcccacccggcucaaggccgccacccagccguccgcccccagcgcggaggcgccccaguccaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5294 - RNA, 517 nt, Artificial Sequence
  mRNA product Design1 comprising derived and/or modified sequence from Lassa virus__AIT17536__Z (opt1)
gggagaaagcuuaccaugggcaaccgccagacccggcccaccgaggccacggagcagagccgcgcccaccuggugccggacgccucccaccucgggccccaguucugcaagagcugcugguucgagaacaagggccuggucgagugcaacaaccacuaccugugccucaacugccugucccugcuccugagcguguccagccggugccccaucugcaagaugccccugccgacccgccucaaggccuccgcccagcccagcgccccgcccaccgaggcgccccagaacaaggcgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5295 - RNA, 517 nt, Artificial Sequence
  mRNA product Design1 comprising derived and/or modified sequence from Lassa virus__AIT17542__Z (opt1)
gggagaaagcuuaccaugggcaaccgccaggucaagagcaccaagguggacgagcaccagcgggcccaccugauccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucgaggcggccgcccagccguccgcccccagcacggaggccacccaggacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5296 - RNA, 517 nt, Artificial Sequence
  mRNA product Design1 comprising derived and/or modified sequence from Lassa virus__AIT17546__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccgcccagccguccgcccccagcacggagaccauccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5297 - RNA, 517 nt, Artificial Sequence
  mRNA product Design1 comprising derived and/or modified sequence from Lassa virus__AIT17550__Z (opt1)
gggagaaagcuuaccaugggcaaccgccaggccaagcagaccaagguggacgagcaccagcgggcccaccugguccccgacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugcccaccaagcucaaggccgccgcccagccgagcgcccccuccacggagaucacccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5298 - RNA, 517 nt, Artificial Sequence
  mRNA product Design1 comprising derived and/or modified sequence from Lassa virus__AIT17554__Z (opt1)
gggagaaagcuuaccaugggcaaccgccaggccaagagcaccaaggccgacgagcaccagcgggcgcaccuggugcccgacgccucccaccucgggccccaguucugcaagagcugcugguucgagaaccgcggccuggucgagugcaacaaccacuaccugugccucaacugccugucccugcuccugagcguguccaaccggugccccaucugcaagaugccccugcccacccgccucaaggccgccgcccagccgagcgcgcccuccacggaggccacccaggacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5299 - RNA, 517 nt, Artificial Sequence
  mRNA product Design1 comprising derived and/or modified sequence from Lassa virus__AIT17558__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccacccgccucaaggccgccgcccagccguccgcccccagcacggaggcgauccgguccaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5300 - RNA, 517 nt, Artificial Sequence
  mRNA product Design1 comprising derived and/or modified sequence from Lassa virus__AIT17570__Z (opt1)
gggagaaagcuuaccaugggcaaccgccaggccaagagcgccaaggugaacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcgcccagcaccgaggccacgcagaacaucaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5301 - RNA, 517 nt, Artificial Sequence
  mRNA product Design1 comprising derived and/or modified sequence from Lassa virus__AIT17578__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcuccgggccgccgcccagccguccgcccccagcacggaguccgcgcagaacaccgccccgccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5302 - RNA, 517 nt, Artificial Sequence
  mRNA product Design1 comprising derived and/or modified sequence from Lassa virus__AIT17586__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccacccggcucaaggccgccgcccagccguccgcccccagcacggaggucacccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5303 - RNA, 517 nt, Artificial Sequence
  mRNA product Design1 comprising derived and/or modified sequence from Lassa virus__AIT17590__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucgaggccacgacccagccguccgcccccagcaccgaggagacccaguccacgaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5304 - RNA, 517 nt, Artificial Sequence
  mRNA product Design1 comprising derived and/or modified sequence from Lassa virus__AIT17602__Z (opt1)
gggagaaagcuuaccaugggcaacaagcaggccaagagcaccaagguggacgaguaccagcgcgcccaccugguccccgacgcgucccaccucgggccccaguucugcaagagcugcugguucgagaaccggggccugguggagugcaacaaccacuaccugugccucaacugccugucccugcuccugagcguguccaaccgcugccccaucugcaagaugccccugcccacccggcucaaggccgccgcccagcccagcgccccgcccacggaggcgacccagaacaccacgccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5305 - RNA, 517 nt, Artificial Sequence
  mRNA product Design1 comprising derived and/or modified sequence from Lassa virus__AIT17610__Z (opt1)
gggagaaagcuuaccaugggcaaccgccaggccaagcccaccaagguggacgagcaccagcgggcccagcuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgaccaagcucaaggccgccacgcagcccagcgcccccuccaccgaggccacccagaacagcacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5306 - RNA, 517 nt, Artificial Sequence
  mRNA product Design1 comprising derived and/or modified sequence from Lassa virus__AIT17614__Z (opt1)
gggagaaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggccacccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5307 - RNA, 517 nt, Artificial Sequence
  mRNA product Design1 comprising derived and/or modified sequence from Lassa virus__AIT17618__Z (opt1)
gggagaaagcuuaccaugggcaaccgccaggccaagagcaccgagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccaaccggugccccaucugcaagaugccccugcccaccaagcucaaggccgccacgcagccgagcgcccccuccaccgaggccacccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5308 - RNA, 517 nt, Artificial Sequence
  mRNA product Design1 comprising derived and/or modified sequence from Lassa virus__AIT17622__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccaucccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5309 - RNA, 517 nt, Artificial Sequence
  mRNA product Design1 comprising derived and/or modified sequence from Lassa virus__AIT17628__Z (opt1)
gggagaaagcuuaccaugggcaacaagcaggccaagagcaccaagaucgacgagcaccagcgcgcccaccuggugcccgacgcgucccaccucgggccgcaguucugcaagagcugcugguucgagaaccggggccuggucgagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5310 - RNA, 517 nt, Artificial Sequence
  mRNA product Design1 comprising derived and/or modified sequence from Lassa virus__AIT17632__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcuccgggccacggcccagccguccgcccccagcaccgaggccauccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5311 - RNA, 517 nt, Artificial Sequence
  mRNA product Design1 comprising derived and/or modified sequence from Lassa virus__AIT17636__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcaucgagacgauccagaacaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5312 - RNA, 517 nt, Artificial Sequence
  mRNA product Design1 comprising derived and/or modified sequence from Lassa virus__AIT17640__Z (opt1)
gggagaaagcuuaccaugggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccgccgcccagccguccgcccccagcacggaggcgacccaggacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5313 - RNA, 517 nt, Artificial Sequence
  mRNA product Design1 comprising derived and/or modified sequence from Lassa virus__AIT17648__Z (opt1)
gggagaaagcuuaccaugggcaaccgccaggccaagagcaccaagguggacgagcaccagcgggcccaccugguccccgacgcgucccaccucgggccgcaguucugcaagagcugcugguucgagaacaagggccugguggagugcaacaaccacuaccugugccucaacugccugucccugcuccugagcguguccagccgcugccccaucugcaagaugccccugcccaccaagcucaaggccacgguccagccguccgcccccagcaccgaggccgcccaguccaccgcgcccccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5314 - RNA, 517 nt, Artificial Sequence
  mRNA product Design1 comprising derived and/or modified sequence from Lassa virus__AIT17652__Z (opt1)
gggagaaagcuuaccaugggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccgccgcccagccguccgcccccagcgcggaggccauccagaagacgaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5315 - RNA, 517 nt, Artificial Sequence
  mRNA product Design1 comprising derived and/or modified sequence from Lassa virus__AIT17656__Z (opt1)
gggagaaagcuuaccaugggcaaccgccaggccaagagcaccaagguggacgaccaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcggcccaggacaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5316 - RNA, 517 nt, Artificial Sequence
  mRNA product Design1 comprising derived and/or modified sequence from Lassa virus__AIT17660__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccaaccggugccccaucugcaagaugccccugcccaccaagcucaaggccgccgcccagccgagcgcccccuccacggaggcgauccagaacaccaccccgccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5317 - RNA, 517 nt, Artificial Sequence
  mRNA product Design1 comprising derived and/or modified sequence from Lassa virus__AIT17664__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaacaagggccugguggagugcaacaaccacuaccugugccucaacugccugucccugcuccugagcguguccagccggugccccaucugcaagaugccccugcccaccaagcucaaggccgccgcccagccguccgcccccagcacggaggcggcccagaacaccgccccgccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5318 - RNA, 517 nt, Artificial Sequence
  mRNA product Design1 comprising derived and/or modified sequence from Lassa virus__AIT17668__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaagacgaccgcccagccguccgccccgcccaccgaggccgccaagaacaccgcgcccccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5319 - RNA, 517 nt, Artificial Sequence
  mRNA product Design1 comprising derived and/or modified sequence from Lassa virus__AIT17676__Z (opt1)
gggagaaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5320 - RNA, 517 nt, Artificial Sequence
  mRNA product Design1 comprising derived and/or modified sequence from Lassa virus__AIT17680__Z (opt1)
gggagaaagcuuaccaugggcaaccgccaggccaagagcaccaagaucgacgagcaccagcgggcccaccuggugcccgacgcgucccaccucgggccccaguucugcaagagcugcugguucgagaaccgcggccuggucgagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5321 - RNA, 517 nt, Artificial Sequence
  mRNA product Design1 comprising derived and/or modified sequence from Lassa virus__AIT17684__Z (opt1)
gggagaaagcuuaccaugggcaaccgccaggccaagagcgccaagguggacgagcaccagcgggcgcaccugguccccgacgccucccaccucgggccccaguucugcaagagcugcugguucgagaacaagggccugguggagugcaacaaccacuaccugugccucaacugccugucccugcuccugagcguguccugccgcugccccaucugcaagaugccccugcccaccaagcucaaggccgccacccagccgagcgcccccuccacggaggcgacccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5322 - RNA, 517 nt, Artificial Sequence
  mRNA product Design1 comprising derived and/or modified sequence from Lassa virus__AIT17692__Z (opt1)
gggagaaagcuuaccaugggcaaccgccacgccaagcccaccaagguggacgagcaccagcgggcccaccuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgaccaagcucaaggccgccgcccagcccagcgcccccuccaccgaggcgauccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5323 - RNA, 517 nt, Artificial Sequence
  mRNA product Design1 comprising derived and/or modified sequence from Lassa virus__AIT17702__Z (opt1)
gggagaaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcguuccagaacaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5324 - RNA, 517 nt, Artificial Sequence
  mRNA product Design1 comprising derived and/or modified sequence from Lassa virus__AIT17708__Z (opt1)
gggagaaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggccauccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5325 - RNA, 517 nt, Artificial Sequence
  mRNA product Design1 comprising derived and/or modified sequence from Lassa virus__AIT17716__Z (opt1)
gggagaaagcuuaccaugggcaaccgccccgccaagagcaccaagguggacgagcaccagcgggcccaccuggucccggacgcgucccaccucgggccccaguucugcaagagcugcugguucgagaaccgcggccugguggagugcaacaaccacuaccugugccucaacugccugucccugcuccugagcguguccagccggugccccaucugcaagaugccccugccgaccaagcucaaggccgccgcccagcccuccgcccccagcacggaggcgacccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5326 - RNA, 517 nt, Artificial Sequence
  mRNA product Design1 comprising derived and/or modified sequence from Lassa virus__AIT17720__Z (opt1)
gggagaaagcuuaccaugggcaaccgccaggccaagcccaccaagguggacgagcaccagcgggcccaccuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgacccgccucaaggccgccgcccagcccagcgcccccuccacggaggagacccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5327 - RNA, 517 nt, Artificial Sequence
  mRNA product Design1 comprising derived and/or modified sequence from Lassa virus__AIT17730__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcgccccugacggaggccauccagaacaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5328 - RNA, 517 nt, Artificial Sequence
  mRNA product Design1 comprising derived and/or modified sequence from Lassa virus__AIT17734__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5329 - RNA, 517 nt, Artificial Sequence
  mRNA product Design1 comprising derived and/or modified sequence from Lassa virus__AIT17738__Z (opt1)
gggagaaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcugccguccgcccccagcaccgaggucacccagaacaccacgcccccgccccacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5330 - RNA, 517 nt, Artificial Sequence
  mRNA product Design1 comprising derived and/or modified sequence from Lassa virus__AIT17750__Z (opt1)
gggagaaagcuuaccaugggcaaccgccaggccaagagcgccaaggugaacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacccagccguccgcccccagcacggaggcgacccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5331 - RNA, 517 nt, Artificial Sequence
  mRNA product Design1 comprising derived and/or modified sequence from Lassa virus__AIT17754__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccuccgcccagccgagcgcccccuccacggaggccgcgcagaacaccgccccgccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5332 - RNA, 517 nt, Artificial Sequence
  mRNA product Design1 comprising derived and/or modified sequence from Lassa virus__AIT17760__Z (opt1)
gggagaaagcuuaccaugggcaaccgccaggccaagagcacccggaccgacgagcaccagcgcgcccaccuggugcccgacgcgucccaccucgggccccaguucugcaagagcugcugguucgagaacaagggccuggucgagugcaacaaccacuaccugugccucaacugccugucccugcuccugagcguguccagccggugccccaucugcaagaugccccugcccacgaagcucaaggccgccgcccagccguccgcccccagcaccgaggcggggcagaacaccgccccgccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5333 - RNA, 517 nt, Artificial Sequence
  mRNA product Design1 comprising derived and/or modified sequence from Lassa virus__AIT17768__Z (opt1)
gggagaaagcuuaccaugggcaaccgccaggccaagagcgccaccguggacgagugccagcgggcgcaccugguccccgacgccuccuaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccgccgcccagccguccgcgcccagcacgcgggccacccagaacaccaccccgccgcccuacacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5334 - RNA, 517 nt, Artificial Sequence
  mRNA product Design1 comprising derived and/or modified sequence from Lassa virus__AIT17776__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaacaagggccugguggagugcaacaaccacuaccugugccucaacugccugucccugcuccugagcguguccagccggugccccaucugcaagaugccccugcccacccgccucaaggccgccgcccagccguccgcccccagcacggaggcgacccagaacgccgccccgccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5335 - RNA, 517 nt, Artificial Sequence
  mRNA product Design1 comprising derived and/or modified sequence from Lassa virus__AIT17780__Z (opt1)
gggagaaagcuuaccaugggcaaccgccagaccaagagcaccaagguggacgagcaccagcgggccuaccugguccccgacgccucccuccuggggccccaguucugcaagagcugcugguucgagaacaagggccugguggagugcaacaaccacuaccucugccugaacugccugucccuccugcugagcguguccagccgcugccccaucugcaagaugccccuccccacgcggcugaaggcggccgcccagcccuccgccccgcccaccgaggccauccagaacaccacgccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5336 - RNA, 517 nt, Artificial Sequence
  mRNA product Design1 comprising derived and/or modified sequence from Lassa virus__AIT17784__Z (opt1)
gggagaaagcuuaccaugggcaaccgccagaccaagcccaccaagguggacgagcaccagcgggcccaccuggucccggacgccagccaccucgggccccaguucugcaaguccugcugguucgagaacaagggccugguggagugcaacaaccacuaccugugccucaacugccugagccugcuccuguccgugagcucccgcugccccaucugcaagaugccccugccgacgaagcucaaggcgaccgcccagcccagcgcccccuccaccgaggccgcccagaacaccgcgcccccgcccuacgcccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5337 - RNA, 517 nt, Artificial Sequence
  mRNA product Design1 comprising derived and/or modified sequence from Lassa virus__AIT17788__Z (opt1)
gggagaaagcuuaccaugggcaaccgccaggucaagagcaccaagguggacgagcaccagcgggcccaccuggugcccgacgccucccaccucgggccccaguucugcaagagcugcugguucgagaaccgcggccugguggagugcaacaaccacuaccugugccucaacugccugucccugcuccugagcgucuccagccggugccccaucugcaagaugccccugcccaccaagcucaaggcggccacgcagccguccgccccgcccaccgaggccacccagaagaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5338 - RNA, 517 nt, Artificial Sequence
  mRNA product Design1 comprising derived and/or modified sequence from Lassa virus__AIT17792__Z (opt1)
gggagaaagcuuaccaugggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccgggcgcugccccaucugcaagaugccccugcccaccaagcucaaggccacggcccagccgagcgcccccuccaccgaggccacccagaacaccacgcccccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5339 - RNA, 517 nt, Artificial Sequence
  mRNA product Design1 comprising derived and/or modified sequence from Lassa virus__AIT17796__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccgcccagccguccgcccccagcacggaggcgauccagaacaccaccccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5340 - RNA, 517 nt, Artificial Sequence
  mRNA product Design1 comprising derived and/or modified sequence from Lassa virus__AIT17800__Z (opt1)
gggagaaagcuuaccaugggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccgcugcccacgaagcuccgccccuccgccacccccaccgccccgcccaccgaggcggccgacagcauccggcccccgcccuaccaccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5341 - RNA, 517 nt, Artificial Sequence
  mRNA product Design1 comprising derived and/or modified sequence from Lassa virus__AIT17804__Z (opt1)
gggagaaagcuuaccaugggcaacaagcaggccaaggccagcgaggagaagaacagcccccgcgccucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcaccacccccaccgcgcccccgacgggggccgccgacuccauccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5342 - RNA, 517 nt, Artificial Sequence
  mRNA product Design1 comprising derived and/or modified sequence from Lassa virus__AIT17808__Z (opt1)
gggagaaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgcgccuccggcccagcgccgcccccaccgccccgcccaccggggcggccgacuccacccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5343 - RNA, 520 nt, Artificial Sequence
  mRNA product Design1 comprising derived and/or modified sequence from Lassa virus__AIT17834__Z (opt1)
gggagaaagcuuaccaugggcaacaagcagacccgcagcccgcccaagcccgagcacccccggcccacccugcuccccgacgccucccaccuggggccccaguucugcaagagcugcugguucgagaacaagggccugguggagugcaacaaccacuaccucugccugaacugccugacgcuccugcuguccgucagcgaccgcugccccaucugcaagaugccccuccccaccaagcuggccgugcggacccagcccuccgcgccgccccugaaccaggggaacacccagagcagcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5344 - RNA, 517 nt, Artificial Sequence
  mRNA product Design1 comprising derived and/or modified sequence from Lassa virus__AIT17838__Z (opt1)
gggagaaagcuuaccaugggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccgcugccccaucugcaagaugccgcugcccacgaagcucaagcccagcgccgcccccaccgccccgcccaccggggccgcggacuccauccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5345 - RNA, 517 nt, Artificial Sequence
  mRNA product Design1 comprising derived and/or modified sequence from Lassa virus__AIT17842__Z (opt1)
gggagaaagcuuaccaugggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccggugccccaucugcaagaugccgcugcccacgaagcuccgccccagcgccgcccccaccgccccgcccaccgggguggccgacuccauccggcccccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5346 - RNA, 517 nt, Artificial Sequence
  mRNA product Design1 comprising derived and/or modified sequence from Lassa virus__ANH09743__Z (opt1)
gggagaaagcuuaccaugggcaacaagcaggccaaggccagcgagguggaggacgggccccgcgccucccugauccccgacgccacccaccucggcccccaguucugcaagagcugcugguucgagaacaagucccuggucgagugcaacaaccacuaccugugccucaacugccugacccugcuccugagcguguccaaccggugccccaucugcaagaugccccugccgacgcgccucaagcccagcgugguccccaccgcgcccccgacccgggccggggacggcacccgcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5347 - RNA, 517 nt, Artificial Sequence
  mRNA product Design1 comprising derived and/or modified sequence from Lassa virus__ANH09745__Z (opt1)
gggagaaagcuuaccaugggcaacaagcagaccaaggcccccgagguggaggacgggccccgcgccagccugauccccgacgcgacccaccucggcccccaguucugcaaguccugcugguucgagaacaaggggcuggucgagugcaacaaccacuaccugugccucaacugccugacgcugcuccugagcguguccagccggugccccaucugcaagaugccgcugcccacccgccucaagcccuccaucgugcccaccgccccgcccgcccggaccggcgagaacacgcgcccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5348 - RNA, 517 nt, Artificial Sequence
  mRNA product Design1 comprising derived and/or modified sequence from Lassa virus__ANH09749__Z (opt1)
gggagaaagcuuaccaugggcaacaagcaggccaaggcccccgagguggaggacgggccccgcgcgagccugauccccgacgccacccaccucggcccccaguucugcaaguccugcugguucgagaaccgggggcuggucgagugcaacaaccacuaccugugccucaacugccugacccugcuccugagcguguccaaccgcugccccaucugcaagaugccgcugcccacgcggcucaagcccagcgugguccccaccgccccgcccaccggcgccgggggcgacacccgcccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5349 - RNA, 517 nt, Artificial Sequence
  mRNA product Design1 comprising derived and/or modified sequence from Lassa virus__ANH09751__Z (opt1)
gggagaaagcuuaccaugggcaacaagcaggccaaggcccccaaggcggaggacgggccgcgcgccagccugauccccgacgccacccaccucggcccccaguucugcaaguccugcugguucgagaacaaggggcugguggagugcaacaaccacuaccugugccucaacugccugacccugcuccugagcgucuccaaccggugccccaucugcaagaugccgcugcccacgcgccucaagcccagcguggugcccaccgccccgcccaccggcgccgggggcgacacccggcccccgccccacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5350 - RNA, 517 nt, Artificial Sequence
  mRNA product Design1 comprising derived and/or modified sequence from Lassa virus__ANH09753__Z (opt1)
gggagaaagcuuaccaugggcaacaagcaggccaaggccagcgaggcggaggacgggccccgcgccucccugauccccgacgccacccaccucggcccccaguucugcaagagcugcugguucgagaacaaggggcugguggagugcaacaaccacuaccugugccucaacugccugacccugcuccuguccgucagcucccggugccccaucugcaagaugccccugccgacgcgccuccggcccagcguggugcccaccgcccccuccgccggcgcgggggacggcacccgcccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5351 - RNA, 517 nt, Artificial Sequence
  mRNA product Design1 comprising derived and/or modified sequence from Lassa virus__ANH09755__Z (opt1)
gggagaaagcuuaccaugggcaacaagcagaccaagaccaucaagaagacggacagcccccgcgccucccugauccccgacgccagccacauggggccccaguucugcaaguccugcugguucgagaaccggggccucguggagugcaacaaccacuaccugugccugaacugccucagccugcugcucuccgucagcaaccgcugccccaucugcaagaugccccugccgaccaagcugcgggcgucccccagccccaccgcccccuccauccgcgaggccaacaucaccaacccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5352 - RNA, 517 nt, Artificial Sequence
  mRNA product Design1 comprising derived and/or modified sequence from Lassa virus__ANH09759__Z (opt1)
gggagaaagcuuaccaugggcaacaagcagaccaagaccacgaagaagaccgacagcccccgcgccucccugauccccgacgccagccacauggggccccaguucugcaaguccugcugguucgagaaccggggccucguggagugcaacaaccacuaccugugccugaacugccucagccugcugcucuccgucagcaaccgcugccccaucugcaagaugccccugccgaccaagcugcgggcgucccccagccccaccgcccccuccauccgcgaggccaacaucacgaacccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5353 - RNA, 517 nt, Artificial Sequence
  mRNA product Design1 comprising derived and/or modified sequence from Lassa virus__ANH09761__Z (opt1)
gggagaaagcuuaccaugggcaacaaggggaccaagcccacccagaacagcgagcccucccgcgccaaccuggugcccgacgccagcuaccucggcccccaguucugcaaguccugcugguucgagaacaaggggcuggucgagugcaacaaccacuaccugugccucaacugccugacgaugcugcucagcguguccaaccggugccccaucugcaagaugccgcugcccaccaagaucaaggccagcggcucccccagcgcgcccccgaccgaggccaacuccgccgugagcccgccgcccuacacccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5354 - RNA, 517 nt, Artificial Sequence
  mRNA product Design1 comprising derived and/or modified sequence from Lassa virus__AMR44579__Z (opt1)
gggagaaagcuuaccaugggcgcccgccagaccaagcagccccagaucgaggggagcccccgggccucccuggugcccgacgcgagccaccucggcccccaguucugcaaguccugcugguucgagaacaaggggcuggucgagugcaacaaccacuaccugugccucaacugccugagccugcuccuguccgugagcaaccgcugccccaucugcaagaugccgcugcccaccaagcuccggguguccagcgcccccuccgcgcccccggccgccacggcccagcccggcaccccgccgcccuacagccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5355 - RNA, 517 nt, Artificial Sequence
  mRNA product Design1 comprising derived and/or modified sequence from Lassa virus__AMZ00378__Z (opt1)
gggagaaagcuuaccaugggcaaccgccagaccaaggccaccgaggccaaggacagcccccgggcgucccugauccccgacgccacgcaccucgggccccaguucugcaagagcugcugguucgagaacaagggccugguggagugcaacaaccacuaccugugccucaacugccugacccugcuccuguccgucagcucccgcugccccaucugcaagaugccccugccgacccggcucaagagcuccaccaaccccacggcccccagcgccaagaccgaguccagcaucaacccgccgcccuacucccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5356 - RNA, 1855 nt, Artificial Sequence
  mRNA product Design2 comprising derived and/or modified sequence from Lassa virus__AAF86703__GPC (opt1) R6027/R6632
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugaucuccuuccuccugcugugcggccgcagcugcuccgugacguacaaggggguguacgagcuccagacccuggagcugaacauggccaaccucaacaugaccaugccgcugagcugcaccaagaacaacucccaccacuacaucauggucggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcgugcaguacaaccucucccacagcuucgcgguggacgccgccaaccacugcgggaccaucgccaacggcguccugcagaccuucaugcggauggcguggggcggguccuacaucgcccuggacagcggcaaggggaacugggacugcaucaugaccuccuaccaguaccucaucauccagaacacgaccugggaggaccacugccaguucagccgccccucccccaucggcuaccuggggcugcucagccagcggacccgcgacaucuacaucagccggcgccugcugggcaccuucacguggacccucuccgacagcgagggcaacgaggcccccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccaucaagcggcucaagacggaggcccagauguccauccagcugaucaacaaggccgugaacgcccugaucaacgaccagcucaucaugaagaaccaccuccgcgacaucaugggcauccccuacugcaacuacagccgguacugguaccugaaccacaccgucaccgggaagaccucccugccccgcugcuggcuggugagcaacggcuccuaccugaacgagacgcacuucagcgacgacaucgagcagcaggcggacaacaugaucaccgagaugcuccagaaggaguacauggaccggcagggcaagaccccgcuggggcugguggaccucuucgucuucuccaccagcuucuaccugaucuccaucuuccugcaccuggugaagaucccgacgcaccgccacaucgugggcaagcccugccccaagccccaccggcucaaccacauggggaucugcagcugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5357 - RNA, 1858 nt, Artificial Sequence
  mRNA product Design2 comprising derived and/or modified sequence from Lassa virus__AAG41802__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcugaucacguuccuccugcugugcggccgcuccugcagcuccaaccucuacaaggggguguacgagcugcagagccuggaccucaacauggagacccugaacaugaccaugccgcuguccugcaccaagaacaacagccaccacuacauccgggucggcaacgacacgggccucgagcugacccugaccaacaccuccauccucaaccacaaguucugcaaccugagcgacgcccacaagaaggaccuguacgaccacgcccucauguccaucaucagcacguuccaccuguccauccccaacuucaaccaguacgaggccaugagcugcgacuucaacgggggcaagaucuccgugcaguacaaccugagccacuccuacgccaucgacgcggccaaccacugcgggaccguggccaacggcauccuccagaccuucaugcgcauggccuggggcgggagcuacaucgcgcuggacuccggccgggggaacugggacugcaucaugaccagcuaccaguaccugaucauccagaacacgaccugggagaaccacugccaguucucccgccccagccccaucggcuaccucgggcugcugagccagcggacccgcgacaucuacaucucccggcgccuccugggcaccuucacguggacccugagcgacuccgagggcaacgccacccccgggggcuacugccucacccgguggaugcugaucgaggccgagcugaagugcuucgggaacacggccgucgccaagugcaacgagaagcacgacgaggaguucugcgacaugcuccgccuguucgacuucaacaagcaggcgaucagccggcugaaguccgaggcccagaugagcauccagcucaucaacaaggccgugaacgcccugaucaacgaccagcugaucaugaagaaccaccuccgcgacaucaugggcauccccuacugcaacuacuccaaguacugguaccugaaccacaccaucaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcagggcaagaccccgcucgggcuggucgaccuguucguguucagcaccuccuucuaccugaucagcaucuuccuccgccuggugaagaucccgacgcaccggcacaucgucggcaagcccugccccaagccccaccgccugaaccacauggggaucugcuccugcggccucuacaagcagccgggggugcccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5358 - RNA, 1855 nt, Artificial Sequence
  mRNA product Design2 comprising derived and/or modified sequence from Lassa virus__AAL13212__GPC (opt1)
ggggcgcugccuacggagguggcagccaucuccuucucggcaucaagcuuaccaugggccagaucgugaccuucuuccaggaggucccccacgugaucgaggagaucaugaacaucgugcugaucacccucagccugcuggccauccucaagggggucuacaaccuggccacgugcggccugaucgggcucaucaccuuccuguuccugugcggccgcuccugcagcaugaccuacaagggguccuaccagcucgagacccuggagcugaacauggagacgcucaacaugaccaugccgcugagcugcaccaagaacaccucccaccacuacauccgggugggcaacgagacgggccuggagcucacccugaccaacaccagcaucaucaaccacaaguucugcaaccuguccgacgcgcacaagaagaaccucuacgaccacagccugauguccaucaucagcacguuccaccuguccauccccaacuucaaccaguacgaggccaugagcugcgacuucaacgggggcaagaucuccauccaguacaaccucagccacaccuacgccggggacgccgccaagcacugcggcacccuggcgaacgggauccugcagaccuucaugcgcauggccuggggcggcuccuacaucgcccucgacagcgggcggggcaacugggacugcaucaugacguccuaccaguaccugaucauccagaacaccaccugggaggaccacugccaguucagccgccccucccccaucggguaccugggccuccugagccagcggacccgcgagaucuacaucagccggcgccugcucggcacguucaccuggacccuguccgacagcgaggggaacgagaacccgggcggguacugccugacccgguggaugcucaucgaggccgagcugaagugcuucggcaacacggcgguggccaagugcaacgagaagcacgacgaggaguucugcgacaugcugcgccucuucgacuucaacaagcaggccauccagcggcugaaggccgaggcccagauguccauccagcugaucaacaaggcggucaacgcccucaucaacgaccagcugaucaugaagaaccaccuccgcgacaucauggggauccccuacugcaacuacagcaaguacugguaccugaaccacaccaccaccggccggacgucccugccccgcugcuggcuggugagcaacggcuccuaccucaacgagacccgguucagcgacgacaucgagcagcaggccgacaacaugaucaccgagaugcugcagaaggaguacaucgaccgccaggggaagacgccccugggccucguggaccuguucgucuucuccaccagcuucuaccugaucuccaucuuccugcaccucaucaagaucccgacccaccggcacaucgucgggggccccugccccaagccccaccgccugaaccacaaggggaucugcagcugcggccuguacaagcggccgggcguguccgugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5359 - RNA, 1858 nt, Artificial Sequence
  mRNA product Design2 comprising derived and/or modified sequence from Lassa virus__AAO59512__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucgccuuccuccugcugugcggccgcuccugcacgagcucccucuacaaggggguguacgagcugcagacccuggagcucaacauggagacccugaacaugaccaugccgcugagcugcacgaagaacaacucccaccacuacauccgggugggcaacgagaccggccucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgguggacgccgccaagcacugcgggaccguggccaacggcguccugcagaccuucaugcgcauggcguggggcggguccuacaucgcccucgacagcggccacgggcggugggacugcaucaugacguccuaccaguaccugaucauccagaacaccaccugggaggaccacugccaguucagccgccccucccccaucggcuaccuggggcuccugagccagcggacccgcgacaucuacaucagccggcgccugcucggcacguucaccuggacccuguccgacagcgagggcaaggacacccccgggggcuacugccugacgcgguggaugcucaucgaggccgagcugaagugcuucgggaacaccgccguggccaagugcaacgagaagcacgacgaggaguucugcgacaugcugcgccucuucgacuucaacaagcaggcgauccagcggcugaagaccgaggcccagauguccauccagcugaucaacaaggccgugaacgcccucaucaacgaccagcugaucaugaagaaccaccuccgcgacaucaugggcauccccuacugcaacuacagccgguacugguaccugaaccacaccacgaccgggaagaccucccugcccaagugcuggcuggucagcaacggcuccuaccucaacgagacccgcuucagcgacgacaucgagcagcaggccgacaacaugaucacggagaugcugcagaaggaguacauggagcggcagggcaagaccccgcuggggcucguggaccuguucguguucuccaccagcuucuaccugaucuccaucuuccugcaccucgucaagaucccgacccaccgccacaucgugggcaagagcugccccaagccccaccggcugaaccacauggggaucugcuccugcggccuguacaagcagcccggggugccggucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5360 - RNA, 1858 nt, Artificial Sequence
  mRNA product Design2 comprising derived and/or modified sequence from Lassa virus__AAT49000__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccucuuccugugcggccgcuccugcagcaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacacccugaugagcaucaucuccaccuuccaccugagcauccccaacuucaaccaguacgaggccauguccugcgacuucaacgggggcaagaucagcguccaguacaaccucucccacagcuacgccguggacgccgcgaaccacugcgggacgguggccaacggcguccugcagaccuucaugcggauggccuggggcggguccuacaucgcccuggacagcggccgcgggaacugggacugcaucaugaccuccuaccaguaccucgugauccagaacaccacgugggaggaccacugccaguucagccggcccucccccaucggcuaccuggggcugcucagccagcgcacccgggacaucuacaucagccgccggcugcugggcaccuucaccuggacgcucuccgacagcgagggcaaggacacccccgggggcuacugccugacccgcuggaugcugaucgaggcggagcucaagugcuucgggaacaccgccguggccaagugcaacgagaagcacgacgaggaguucugcgacaugcugcggcuguucgacuucaacaagcaggccauccagcgccucaaggccgaggcgcagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugcccaagugcuggcuggugagcaacggcuccuaccugaacgagacccacuucagcgacgacaucgagcagcaggccgacaaccucaucacggagaugcugcagaaggaguacauggagcgccagggcaagaccccgcuggggcucgucgaccuguucguguucuccaccagcuucuaccugaucuccaucuuccugcaccucgugaagaucccgacccaccggcacaucgucggcaagcccugccccaagccccaccgccugaaccacauggggaucugcagcugcggcguguacaagcagccgggggugcccguccgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5361 - RNA, 1858 nt, Artificial Sequence
  mRNA product Design2 comprising derived and/or modified sequence from Lassa virus__AAT49004__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5362 - RNA, 1858 nt, Artificial Sequence
  mRNA product Design2 comprising derived and/or modified sequence from Lassa virus__AAT49008__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccucuuccugugcggccgcuccugcagcaccacccuguacaaggggguguacgagcuccagacccuggagcugaacauggagacgcucaacaugaccaugccgcuguccugcaccaagaacaacagccaccacuacaucauggugggcaacgagaccggccuggagcucacgcugaccaacaccuccaucaucaaccacaaguucugcaaccugagcgacgcccacaagaagaaccucuacgaccacacccugauguccaucaucagcacguuccaccuguccauccccaacuucaaccaguacgaggccaugagcugcgacuucaacgggggcaagaucuccguccaguacaaccucagccacuccuacgccguggacgccgcgaaccacugcgggaccguggccaacggcguccugcagaccuucaugcggauggccuggggcgggagcuacaucgcccuggacuccggccgcgggaacugggacugcaucaugaccagcuaccaguaccucaucauccagaacacgaccugggaggaccacugccaguucucccggcccagccccaucggcuaccuggggcugcucucccagcgcacccgggacaucuacaucagccgccggcugcugggcaccuucacguggacccucagcgacuccgagggcaaggacacccccgggggcuacugccugacccgcuggaugcugaucgaggcggagcucaagugcuucgggaacacggccguggccaagugcaacgagaagcacgacgaggaguucugcgacaugcugcggcuguucgacuucaacaagcaggccauccagcgccucaaggccgaggcgcagaugagcauccagcugaucaacaaggccgugaacgcccugaucaacgaccagcucaucaugaagaaccaccuccgggacaucaugggcauccccuacugcaacuacucccgcuacugguaccugaaccacaccgucaccgggaagaccagccugcccaagugcuggcugguguccaacggcagcuaccugaacgagacgcacuucuccgacgacaucgagcagcaggccgacaaccucaucaccgagaugcugcagaaggaguacauggagcggcagggcaagaccccgcuggggcucguggaccuguucgucuucagcaccuccuucuaccugaucagcaucuuccugcaccucgugaagaucccgacgcaccgccacaucgugggcaagcccugccccaagccccaccggcugaaccacauggggaucugcuccugcggcgucuacaagcagccgggggugcccgugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5363 - RNA, 1855 nt, Artificial Sequence
  mRNA product Design2 comprising derived and/or modified sequence from Lassa virus__AAT49010__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcgugcuggccauccugaaggggcucuacaacuucgcgaccugcggccugaucgggcuggugacguuccuccugcuguccggccgcagcugcuccaugaucuacaagggggucuacgagcuccagacccuggagcugaacauggagacccucaacaugaccaugccgcugagcugcacgaagaacaccucccaccacuacauccgggugggcaacgacaccggccuggagcucacccugacgaacgagacccugcuccaccacaaguucugcaaccugagcgacgcccacaagcgcaaccuguacgaccacgcccucauguccaucaucagcaccuuccaccuguccauccccaacuucaaccaguacgaggccaugagcugcgacuucaacgggggcaagaucaccgugcaguacaaccugucccacagcuacgccgucgacgcggccaagcacugcgggacgguggccaacggcgugcuccagaccuucaugcggauggccuggggcggguccuacaucgcgcuggacagccgccacggcaacugggacugcaucaugaccuccuaccaguaccugaucauccagaacaccacgugggaggaccacugccaguucagccggcccucccccaucggguaccucggccugcugagccagcgcacccgggacaucuacaucucccgccggcuccuggggaccuucaccuggacgcugagcgacagcgagggcaacgagaccccgggcggguacugccucacccgcuggaugcugaucgaggccgagcugaagugcuucggcaacaccgccgucgccaagugcaacgagaagcacgacgaggaguucugcgacaugcuccggcuguucgacuucaacaagcaggccauccgccggcugaagacggaggcgcagauguccauccagcucaucaacaaggccgugaacgcccugaucaacgaccagcugaucaugaagaaccaccuccgcgacaucauggggauccccuacugcaacuacagcaaguacugguaccugaaccacaccuccaccggcaagaccagccugccccggugcuggcucguguccaacgggagcuaccugaacgagacgcacuucuccgacgacaucgagcagcaggccgacaacaugaucaccgagaugcugcagaaggaguaccucgaccgccagggcaagacgccccugggccuggucgaccuguucguguucagcaccuccuucuaccucaucagcaucuuccugcaccugaucaagaucccgacccaccggcacaucguggggaagcccugccccaagccccaccgccucaaccacaugggcaucugcuccugcgggcuguacaagcagccgggcguccccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5364 - RNA, 1855 nt, Artificial Sequence
  mRNA product Design2 comprising derived and/or modified sequence from Lassa virus__AAT49014__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggcuguacaacaucgcgaccugcggcaucaucgggcuggucgccuuccucuuccugugcggcaaguccugcagccugacgcucaagggcggguacgagcugcagacccuggagcucaacauggagacccugaacaugaccaugccgcuguccugcacgaagaacagcucccaccacuacauccgcgugggcaacgagaccgggcucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacggcgggaagaucagcgugcaguacaaccugucccacagcuacgcgggcgacgccgccgagcacugcgggaccgucgccaacggcgugcugcagaccuucaugcggauggcguggggcgggcgcuacaucgcccucgacuccggcaaggggaacugggacugcaucaugacgagcuaccaguaccugaucauccagaacaccaccugggaggaccacugccaguucucccggcccagccccaucggcuaccugggccuccugucccagcgcacccgggacaucuacaucagccgccggcugcucgggacguucaccuggacccugagcgacuccgagggcaacgagacccccgggggcuacugccugacgcgcuggaugcucaucgaggccgagcugaagugcuucgggaacaccgccguggccaagugcaacgagaagcacgacgaggaguucugcgacaugcugcggcuguucgacuucaacaagcaggcgauccgccggcugaaggccgaggcccagaugagcauccagcugaucaacaaggccgucaacgcccucaucaacgaccagcugaucaugaagaaccaccuccgcgacaucaugggcauccccuacugcaacuacuccaaguacugguaccucaaccacaccagcuccggccggaccagccugcccaagugcuggcugaucuccaacgggagcuaccucaacgagacgcaguucuccgacgacaucgagcagcaggcggaccacaugaucaccgagaugcugcagaaggaguacaucgagcgccagggcaagaccccgcuggggcucguggacaucuucaucuucagcaccuccuucuaccugaucagcaucuuccugcaccugaucaagaucccgacgcaccggcacaucgugggcaagcccugccccaagccccaccgccucaaccacaugggggucugcuccugcggccuguacaagcacccgggcgugcccaccaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5365 - RNA, 1858 nt, Artificial Sequence
  mRNA product Design2 comprising derived and/or modified sequence from Lassa virus__AAV54104__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgagggggaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5366 - RNA, 1858 nt, Artificial Sequence
  mRNA product Design2 comprising derived and/or modified sequence from Lassa virus__ADI39451__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcgugcuggccgugcugaaggggcucuacaacgucgcgaccugcggccugaucgggcugaucgccuuccuccugcugugcggccgcuccugcacgaccacccucuacaaggggguguacgagcugcaggcccuggagcucaacauggagacccugaacaugacgaugccgcugagcugcaccaagaacaacucccaccacuacaucauggugggcaacgagaccggccucgagcugacccugacgaacaccagcaucaucaaccacaaguucugcaaccucuccgacgcccacaagaagaaccuguacgaccacgcccugaugagcaucaucuccaccuuccaccucagcauccccaacuucaaccaguacgaggcgauguccugcgacuucaacgggggcaagaucagcguccaguacaaccugucccacaccuacgccguggacgccgccaaccacugcgggacgguggcgaacggcguccugcagaccuucaugcggauggccuggggcgggagcuacaucgcccucgacuccggccgcgggagcugggacugcaucaugaccuccuaccaguaccugaucauccagaacaccacgugggaggaccacugccaguucagccggcccucccccaucggcuaccuggggcuccugagccagcgcacccgggacaucuacaucucccgccggcugcucggcaccuucaccuggacgcugagcgacagcgagggcaaggacacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgccugaaggccgaggcccagauguccauccagcugaucaacaaggccgugaacgcgcucaucaacgaccagcugaucaugaagaaccaccuccgggacaucaugggcauccccuacugcaacuacagcaaguacugguaccucaaccacacgaucaccgggcgcaccucccugcccaagugcuggcuggucagcaacggcuccuaccucaacgagacccacuucagcgacgacaucgagcagcaggccgacaacaugaucacggagaugcugcagaaggaguacaucgagcggcagggcaagaccccgcuggggcucguggaccuguucguguucuccaccagcuucuaccugaucuccaucuuccugcaccucaucaagaucccgacccaccgccacaucgucaacaagcccugccccaagccccaccggcugaaccacaugggcgugugcagcugcgggcuguacaagcagccgggcgugcccguccgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5367 - RNA, 1855 nt, Artificial Sequence
  mRNA product Design2 comprising derived and/or modified sequence from Lassa virus__ADU56610__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugaucuccuuccuccugcugugcggccgcagcugcuccacgaccuacaaggggguguacgagcuccagacccuggagcuggacauggccaaccucaacaugaccaugccgcugagcugcacgaagaacuccagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaaggggaacugggacugcaucaugacguccuaccaguaccucaucauccagaacaccaccugggaggaccacugccaguucagccgccccucccccaucggcuaccuggggcugcucagccagcggacccgcgacaucuacaucagccggcgccugcugggcacguucaccuggacccucuccgacagcgagggcaacgaggcccccgggggcuacugccugacccgguggaugcugaucgaggccgagcucaagugcuucgggaacacggcgaucgccaagugcaacgagaagcacgacgaggaguucugcgacaugcugcgccuguucgacuucaacaagcaggccaucaagcggcucaaggccgaggcccagauguccauccagcugaucaacaaggcggugaacgcccugaucaacgaccagcucaucaugaagaaccaccuccgcgacaucaugggcauccccuacugcaacuacagcaaguacugguaccugaaccacaccgugaccgggaagaccucccugccccggugcuggcugaucagcaacggcuccuaccugaacgagacgcacuucagcgacgacaucgagcagcaggccgacaacaugaucaccgagcuccugcagaaggaguacauggaccgccagggcaagaccccgcuggggcucgucgaccuguucguguucuccaccagcuucuaccugaucuccaucuuccugcaccucgugaagaucccgacgcaccggcacaucgucggccgccccugccccaagccccaccggcugaaccacauggggaucugcagcugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5368 - RNA, 1855 nt, Artificial Sequence
  mRNA product Design2 comprising derived and/or modified sequence from Lassa virus__ADU56618__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccauccugaaggggcucuacaacaucgcgaccugcggccugaucgggcuggugacguuccuccugcuguccggccgcagcugcuccaugaccuacaaggggguguacgagcuccagacccuggagcugaacaugaacacccucaacaugacgaugccgcugagcugcaccaagaacaacucccaccacuacaucauggucggcaacgagaccggccuggagcucacccugacgaacaccagccugcuccaccacaaguucugcaaccuguccgacgcccacaagaagaaccuguacgaccacacccucaugagcaucaucuccaccuuccaccugagcauccccaacuucaaccaguacgaggccauguccugcgacuucaacgggggcaagaucacggugcaguacaaccugagccacuccuacgccaucgacgccgcgaaccacugcgggaccguggccaacggcguccuccagaccuucaugcggauggccuggggcgggagcuacaucgcccuggacuccggccgcgggaagugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgagacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccgccggcugaaggccgaggcgcagaugagcauccagcucaucaacaaggccgugaacgcccugaucaacgaccagcugaucaugaagaaccaccuccgcgacaucaugggcauccccuacugcaacuacuccaaguacugguaccugaaccacaccagcaccgggcggaccucccugccccgcugcuggcucgucagcaacggcuccuaccugaacgagacgcacuucagcgacgacaucgagcagcaggccgacaacaugaucaccgagaugcugcagaaggaguaccucgaccggcagggcaagaccccgcuggggcugguggaccuguucguguucuccaccagcuucuaccucaucuccaucuuccugcaccuggucaagaucccgacgcaccgccacaucgugggcaagcccugccccaagccccaccggcucaaccacauggggaucugcagcugcggccuguacaagcagccgggggugcccguccgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5369 - RNA, 1855 nt, Artificial Sequence
  mRNA product Design2 comprising derived and/or modified sequence from Lassa virus__ADU56622__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5370 - RNA, 1855 nt, Artificial Sequence
  mRNA product Design2 comprising derived and/or modified sequence from Lassa virus__ADU56626__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcugaacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccgucacggggaagaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5371 - RNA, 1855 nt, Artificial Sequence
  mRNA product Design2 comprising derived and/or modified sequence from Lassa virus__ADU56630__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugcgcaucccgacccaccggcacgugaucggcaagcccugccccaagccccaccgccugaaccacauggggaucugcuccugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5372 - RNA, 1858 nt, Artificial Sequence
  mRNA product Design2 comprising derived and/or modified sequence from Lassa virus__AFY05588__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggaccuguacaucagccgccggcuccugggcaccuucaccuggacgcugagcgacuccgagggggaggacaccccgggcggguacugccucacccgcuggaugcugaucgaggccgagcugaagugcuucggcaacaccgccguggccaagugcaacgagaagcacgacgaggaguucugcgacaugcuccggcuguucgacuucaacaagcaggccauccagcgccugaaggcggaggcccagaugagcauccagcucaucaacaaggccgugaacgcccugaucaacgaccagcugaucaugaagaaccaccuccgggacaucauggggauccccuacugcaacuacuccaaguacugguaccugaaccacacgaccaccggccgcaccagccugcccaagugcuggcucgucuccaacggcagcuaccugaacgagacgcacuucuccgacgacaucgagcagcaggccgacaacaugaucaccgagaugcugcagaaggaguacauggagcggcaggggaagacgccccucggccugguggaccuguucguguucagcaccuccuucuaccugaucagcaucuuccuccaccuggucaagaucccgacccaccgccacaucguggggaaguccugccccaagccccaccggcugaaccacaugggcaucugcagcugcgggcucuacaagcagcccggcgugccggucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5373 - RNA, 1858 nt, Artificial Sequence
  mRNA product Design2 comprising derived and/or modified sequence from Lassa virus__AFY05590__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacauguacaucagccgccggcugcucggcaccuucaccuggacgcugagcgacuccgagggggaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5374 - RNA, 1858 nt, Artificial Sequence
  mRNA product Design2 comprising derived and/or modified sequence from Lassa virus__AHC95553__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguucuuccuccugugcggccgcuccugcagcuccaaccuguacaagggggucuacgagcuccagagccuggaccugaacauggagacccucaacaugaccaugccgcuguccugcaccaagaacaacagccaccacuacauccgggugggcaacgagacgggccuggagcucacccugaccaacaccucccugcucgaccacaaguucugcaaccugagcgacgcccacaagaagaaccuguacgaccacgcccucauguccaucaucagcacguuccaccuguccauccccaacuucaaccaguacgaggccaugagcugcgacuucaacgggggcaagaucaccgugcaguacaaccugucccacagcuacgccggggacgcggcccgccacugcggcaccaucgccaacgggguccuccagaccuucaugcggauggccuggggcggcuccuacaucgcgcuggacagcgggcacggcaacugggacugcaucaugacguccuaccaguaccugaucauccagaacaccaccugggaggaccacugccaguucagccgccccucccccaucggguaccucagccugcugagccagcggacccgcgacaucuacaucucccggcgccuccugggcacguucaccuggacccugagcgacuccgagggcaacgccacccccgggggcuacugccucacgcgguggaugcugaucgaggccgagcugaagugcuucgggaacaccgccguggccaagugcaacgagaagcacgacgaggaguucugcgacaugcuccgccuguucgacuucaacaagcaggcgaucagccggcugcgcuccgaggcccagaugagcauccagcucaucaacaaggccgugaacgcccugaucaacgaccagcugaucaugaagaaccaccuccgggacaucaugggcauccccuacugcaacuacuccaaguacugguaccugaaccacaccgucaccgggcgcacgagccugcccaagugcuggcucguguccaacggcagcuaccugaacgagacccacuucuccgacgacaucgagcagcaggccgacaacaugaucaccgagaugcugcagaaggaguacauggaccggcagggcaagaccccgcucgggcugguggaccuguucgucuucagcacguccuucuaccugaucagcaucuuccuccaccuggugaagaucccgacccaccgccacaucgugggcaagcccugccccaagccccaccggcugaaccgcauggggaucugcuccugcggccucuacaagcagccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5375 - RNA, 1858 nt, Artificial Sequence
  mRNA product Design2 comprising derived and/or modified sequence from Lassa virus__AHC95555__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguuccuccugcugugcggccgcuccugcagcuccaaccucuacaagggggucuacgagcugcagagccuggaccucaacauggagacccugaacaugaccaugccgcuguccugcaccaagaacaacagccaccacuacauccgggccggcaacgagacgggccucgagcugacccugaccaacaccucccucaucaaccacaaguucugcaaccugagcgacgcccacaagaagaaccuguacgaccacacgcucauguccaucaucagcaccuuccaccuguccauccccaacuucaaccaguacgaggccaugagcugcgacuucaacgggggcaagaucuccgugcaguacaaccugagccacgccuacgcgaucgacgccgccgagcacugcgggaccguggccaacggcguccuccagaccuucaugcgcauggcguggggcggguccuacaucgcccuggacagcggccgggggaacugggacugcaucaugacguccuaccaguaccugaucauccagaacaccaccugggaggaccacugccaguucagccgccccucccccaucggcuaccucgggcugcugagccagcggacccgcgacaucuacaucagccggcgccuccugggcacguucaccuggacccuguccgacagcgagggcaacgccacccccgggggcuacugccucacgcgguggaugcugaucgaggccgagcugaagugcuucgggaacaccgccguggcgaagugcaacgagaagcacgacgaggaguucugcgacaugcuccgccuguucgacuucaacaagcaggccaucucccggcucaagagcgaggcccagauguccauccagcugaucaacaaggccgugaacgcccugaucaacgaccagcugaucaugaagaaccaccuccgcgacaucaugggcauccccuacugcaacuacagcaaguacugguaccugaaccacaccaucaccgggcggacgucccugcccaagugcuggcucgucagcaacggcuccuaccugaacgagacccacuucagcgacgacaucgagcagcaggcggacaacaugaucaccgagaugcugcagaaggaguacauggagcgccagggcaagaccccgcucgggcugguggaccuguucguguucuccacgagcuucuaccugaucuccaucuuccuccaccuggucaagaucccgacccaccggcacaucgugggcaagcccugccccaagccccaccgccugaaccacauggggaucugcagcugcggccucuacaagcagccgggggugccccugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5376 - RNA, 1858 nt, Artificial Sequence
  mRNA product Design2 comprising derived and/or modified sequence from Lassa virus__AHC95557__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguucuuccuccugugcggccgcuccugcagcuccaaccuguacaagggggucuacgagcuccagagccuggaccugaacauggagacccucaacaugaccaugccgcuguccugcaccaagaacaacagccaccacuacauccgggugggcaacgagacgggccuggagcucacccugaccaacaccucccugcucaaccacaaguucugcaaccugagcgacgcccacaagcgcaaccuguacgaccacgcccucauguccaucaucagcacguuccaccuguccauccccaacuucaaccaguacgaggccaugagcugcgacuucaacgggggcaagaucaccgugcaguacaaccugucccacagcuacgccggggacaccgcgaagcacugcggcaccaucgccaacgggguccuccagacguucaugcggauggccuggggcggcuccuacaucgcccuggacagcgggcacggcaacugggacugcaucaugaccuccuaccaguaccugaucauccagaacaccaccugggaggaccacugccaguucagccgccccucccccaucggguaccucggccugcugagccagcggacgcgcgacaucuacaucagccggcgccuccugggcaccuucaccuggacccuguccgacagcgaggggaacgcgacgccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccaucucccggcugcgcagcgaggcgcagauguccauccagcucaucaacaaggccgugaacgcccugaucaacgaccagcugaucaugaagaaccaccuccgggacaucauggggauccccuacugcaacuacagcaaguacugguaccugaaccacaccgucacgggccgcaccucccugcccaagugcuggcucgugagcaacggcuccuaccugaacgagacccacuucagcgacgacaucgagcagcaggccgacaacaugaucaccgagaugcugcagaaggaguacauggaccggcaggggaagacgccccucggccugguggaccuguucgucuucuccaccagcuucuaccugaucuccaucuuccuccaccuggugaagaucccgacccaccgccacaucguggggaagcccugccccaagccccaccggcugaaccgcaugggcaucugcagcugcgggcucuacaagcagccgggcguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5377 - RNA, 1858 nt, Artificial Sequence
  mRNA product Design2 comprising derived and/or modified sequence from Lassa virus__AHC95559__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagcauccuggccguccugaaggggcucuacaacaucgcgaccugcggccugaucgggcuggugacguuccuccugcugugcggccgcuccugcagcuccagccucuacaaggggguguacgagcugcagucccuggaccucaacauggagacccugaacaugaccaugccgcugagcugcaccaagaacaacucccaccacuacauccgggucggcaacgagacgggccucgagcugacccugaccaacaccagccucaucaaccacaaguucugcaaccuguccgacgcccacaagaagaaccuguacgaccacgcccucaugagcaucaucuccacguuccaccugagcauccccaacuucaaccaguacgaggccauguccugcgacuucaacgggggcaagaucagcgugcaguacaaccugucccacgccuacgcgaucgacgccgccagccacugcgggaccguggccaacggcguccuccagaccuucaugcgcauggcguggggcggguccuacaucgcccuggacagcggccacgggaacugggacugcaucaugaccuccuaccaguaccugaucauccagaacacgaccugggaggaccacugccaguucagccggcccagccccaucggcuaccucgggcugcugucccagcgcacccgggacaucuacaucagccgccggcuccugggcaccuucacguggacccuguccgacagcgagggcaacgccacccccgggggcuacugccucacccgcuggaugcugaucgaggccgagcugaagugcuucgggaacacggccguggcgaagugcaacgagaagcacgacgaggaguucugcgacaugcuccggcuguucgacuucaacaagcaggccaucucccgccucaagagcgaggcccagauguccauccagcugaucaacaaggccgugaacgcccugaucaacgaccagcugaucaugaagaaccaccuccgggacaucaugggcauccccuacugcaacuacagcaaguacugguaccugaaccacaccgucaccgggaagaccucccugcccaagugcuggcucgugagcaacggcuccuaccugaacgagacgcacuucagcgacgacaucgagcagcaggcggacaacaugaucaccgagaugcugcagaaggaguacauggagcgccagggcaagaccccgcucgggcugguggaccuguucgucuucuccaccagcuucuaccugaucuccaucuuccuccaccuggugaagaucccgacgcaccggcacaucgugggcaagcccugccccaagccccaccgccugaaccacauggggaucugcagcugcggccucuacaagcagccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5378 - RNA, 1858 nt, Artificial Sequence
  mRNA product Design2 comprising derived and/or modified sequence from Lassa virus__AIT17126__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcugcucacguuccugcugcucugcggccgcuccugcaccaccgggcuguacaagggcgucuacgagcugcagacccucgagcugaacauggagacgcugaacaugaccaugccgcucagcugcaccaagaacaacucccaccacuacaucauggugggcaacgagaccgggcuggagcugacgcucaccaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacggcgggaagaucagcgugcaguacaaccugucccacagcuacgccggcgacgcggccgaccacugcgggacggucgccaacggcgugcuccagaccuucaugcggauggccuggggcggguccuacaucgcgcuggacagcggccgcgggcggugggacugcaucaugaccuccuaccaguaccugaucauccagaacaccacgugggaggaccacugccaguucagccgccccucccccaucggcuaccucggccugcugagccagcggacccgcgacaucuacaucucccggcgccuccuggggaccuucaccuggacgcugagcgacagcgagggcaaggacacccccgggggcuacugccucacccgguggaugcugaucgaggccgagcugaagugcuucgggaacaccgccguggccaagugcaacgagaagcacgacgaggaguucugcgacaugcuccgccuguucgacuucaacaagcaggccauccagcggcugaaggcggaggcccagauguccauccagcucaucaacaaggccgucaacgcccugaucaacgaccagcuggugaugaagaaccaccuccgcgacaucaugggcauccccuacugcaacuacagccgguacugguaccugaaccacacgaccaccggccgcaccucccugcccaagugcuggcucgugagcaacggguccuaccugaacgagacgcacuucagcgacgacaucgagcagcaggccgacaacaugaucaccgagaugcugcagaaggaguacauggagcggcagggcaagaccccgcucgggcuggucgaccuguucguguucuccaccagcuucuaccugaucuccaucuuccuccaccuggugaagaucccgacgcaccgccacaucgucggcaagagcugccccaagccccaccggcugaaccacauggggaucugcuccugcggccucuacaagcagcccggcgugccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5379 - RNA, 1858 nt, Artificial Sequence
  mRNA product Design2 comprising derived and/or modified sequence from Lassa virus__AIT17130__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggcuucguggggcuggucacguuccugcuccugugcggccgcuccugcaccaccagccuguacaaggggguguacgagcuccagacccuggagcugaacauggagacgcucaacaugaccaugccgcuguccugcaccaagaacaacagccaccacuacauccgggugggcaacgacaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccagccacugcgggacgaucgccaacggcgugcugcagaccuucaugcgcauggccuggggcggguccuacaucgcgcuggacagcggccgggaccgcugggacugcaucaugaccuccuaccaguaccucaucauccagaacaccacgugggaggaccacugccaguucagccggcccucccccaucggguaccugggccugcucagccagcgcacccgggacaucuacaucagccgccggcugcuggggaccuucaccuggacgcucuccgacagcgagggcaaggacaccccgggcggguacugccugacccgcuggaugcugaucgaggccgagcucaagugcuucggcaacaccgccgucgccaagugcaacgagaagcacgacgaggaguucugcgacaugcugcggcuguucgacuucaacaagcaggccauccagcgccucaaggcggaggcccagauguccauccagcugaucaacaaggccgugaacgcccugaucaacgaccagcucaucaugaagaaccaccuccgggacaucauggggauccccuacugcaacuacagcaaguacugguaccugaaccacacgaccaccggcaagaccucccugcccaagugcuggcuggugagcaacggguccuaccugaacgagacgcacuucagcgacgacaucgagcagcaggccgacaacaugaucaccgagaugcuccagaaggaguacauggagcgccagggcaagacgccccugggccuggucgaccucuucguguucuccaccagcuucuaccugaucuccaucuuccugcaccuggugaagaucccgacccaccggcacaucgucggcaagagcugccccaagccccaccgccucaaccacauggggaucugcuccugcgggcuguacaagcagcccggcgugccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5380 - RNA, 1858 nt, Artificial Sequence
  mRNA product Design2 comprising derived and/or modified sequence from Lassa virus__AIT17134__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcgggcuguacaagcagcccggcgugccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5381 - RNA, 1858 nt, Artificial Sequence
  mRNA product Design2 comprising derived and/or modified sequence from Lassa virus__AIT17138__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccucccugaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccagccacugcgggacgguggccaacggcguccugcagaccuucaugcggauggccuggggcggguccuacaucgcgcuggacagcggccgcgggggcugggacugcaucaugaccuccuaccaguaccucaucauccagaacaccacgugggaggaccacugccaguucagccggcccucccccaucggguaccugggccugcucagccagcgcacccgggacaucuacaucagccgccggcugcugggcaccuucaccuggacgcucuccgacagcgaggggaaggacaccccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggccauccagcgccucaaggcggaggcccagauguccauccagcugaucaacaaggccgugaacgcccugaucaacgaccagcucaucaugaagaaccaccuccgggacaucauggggauccccuacugcaacuacagcaaguacugguaccugaaccacacgaccaccggccgcaccucccugccccggugcuggcuggucagcaacggcuccuaccugaacgagacgcacuucagcgacgacaucgagcagcaggccgacaacaugaucaccgagaugcuccagaaggaguacauggagcgccaggggaagacgccccugggccugguggaccuguucguguucuccaccagcuucuaccucaucuccaucuuccugcaccuggucaagaucccgacccaccggcacaucgugggcaagagcugccccaagccccaccgccucaaccacauggggaucugcuccugcgggcuguacaagcagcccggcgugccggucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5382 - RNA, 1858 nt, Artificial Sequence
  mRNA product Design2 comprising derived and/or modified sequence from Lassa virus__AIT17142__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcgugcuggccgugcugaaggggcucuacaacuucgcgaccugcggcaucgucgggcuggugacguuccugcuccugugcggccgcuccugcaccaccagccuguacaaggggguguacgagcuccagacccuggagcugaacauggagacgcucaacaugaccaugccgcuguccugcaccaagaacaacagccaccacuacaucauggucggcaacgacaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacuccuacgccggggacgcggccgaccacugcggcacgguggccaacgggguccugcagaccuucaugcggauggccuggggcggcagcuacaucgcgcuggacuccgggcgcggccggugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugcccaagugcuggcuggucuccaacggcagcuaccugaacgagacgcacuucuccgacgacaucgagcagcaggccgacaacaugaucaccgagaugcuccagaaggaguacauggagcggcaggggaagacgccccugggccugguggaccucuucguguucagcaccuccuucuaccugaucagcaucuuccugcaccuggucaagaucccgacccaccgccacaucguggggaagcccugccccaagccccaccggcucaaccacaugggcaucugcuccugcgggcuguacaagcagccgggcgugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5383 - RNA, 1858 nt, Artificial Sequence
  mRNA product Design2 comprising derived and/or modified sequence from Lassa virus__AIT17146__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggccggugggacugcaucaugaccagcuaccaguaccugaucauccagaacaccacgugggaggaccacugcuccuucagccgccccucccccaucggguaccucggccugcugagccagcggacccgcgacaucuacaucagccggcgccuccugggcaccuucaccuggacgcuguccgacagcgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagauguccauccagcucaucaacaaggccgugaacgcccugaucaacgaccagcugaucaugaagaaccaccuccgcgacaucauggggauccccuacugcaacuacagcaaguacugguaccugaaccacacgaccaccggcaagaccucccugcccaagugcuggcucgugagcaacggcuccuaccugaacgagacgcacuucagcgacgacaucgagcagcaggccgacaacaugaucaccgagaugcugcagaaggaguacauggagcggcaggggaagacgccccucggccuggucgaccuguucguguucuccaccagcuucuaccugaucuccaucuuccuccaccuggugaagaucccgacccaccgccacaucgucggcaagagcugccccaagccccaccggcugaaccacauggggaucugcuccugcggguucuacaagcagcccggcgugccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5384 - RNA, 1858 nt, Artificial Sequence
  mRNA product Design2 comprising derived and/or modified sequence from Lassa virus__AIT17154__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggcaucguggggcuggucuccuuccugcuccugugcggccgcagcugcacgaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacagcuacgccggggacgcggccaaccacugcggcaccaucgccaacggggugcugcagacguucaugcggauggccuggggcggcuccuacaucgcgcuggacagcgggcgcgaccggugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaaggacacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccagcggcucaaggcggaggcccagauguccauccagcugaucaacaaggccgucaacgcccugaucaacgaccagcucaucaugaagaaccaccuccgcgacaucaugggcauccccuacugcaacuacagcaaguacugguaccugaaccacaccacgaccgggaagaccucccugcccaagugcuggcuggugagcaacggcuccuaccugaacgagacccacuucagcgacgacaucgagcagcaggccgacaacaugaucacggagaugcuccagaaggaguacauggagcggcagggcaagaccccgcuggggcugguggaccucuucgucuucuccaccagcuucuaccugaucuccaucuuccugcaccuggugaagaucccgacccaccgccacguggucggcaagagcugccccaagccccaccggcucaaccacauggggaucugcuccugcggccuguacgggcagcccggcgugccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5385 - RNA, 1858 nt, Artificial Sequence
  mRNA product Design2 comprising derived and/or modified sequence from Lassa virus__AIT17158__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaaguccugccccaagccccaccggcugaaccacauggggaucugcagcugcggccuguacaagcagcccggggugccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5386 - RNA, 1858 nt, Artificial Sequence
  mRNA product Design2 comprising derived and/or modified sequence from Lassa virus__AIT17164__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccagcucccucuacaaggggguguacgagcugcagacccuggagcucaacauggagacccugaacaugacgaugccgcugagcugcaccaagaacaacucccaccacuacauccgggugggcaacgagaccggccucgagcugacccugacgaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgccggggacgcggccaagcacugcggcaccguggccaacggggugcugcagacguucaugcgcauggccuggggcggcuccuacaucgcgcucgacagcgggcacggcaacugggacugcaucaugaccuccuaccaguaccugaucauccagaacaccaccugggaggaccacugccaguucagccggcccucccccaucggguaccugggccuccugagccagcgcacgcgggacaucuacaucagccgccggcugcucggcaccuucaccuggacccuguccgacagcgaggggaacgacgccccgggcggguacugccugacgcgcuggaugcucauccaggccgagcugaagugcuucggcaacaccgccgucgccaagugcaacgagaagcacgacgaggaguucugcgacaugcugcggcuguucgacuucaacaagcaggcgauccagcgccugaaggccgaggcccagauguccauccagcugaucaacaaggccgugaacgcccucaucaacgaccagcugaucaugaagaaccaccuccgggacaucauggggauccccuacugcaacuacagcaaguacugguaccucaaccacaccaccacgggccgcaccucccugccccggugcuggcuggugagcaacggcuccuaccucaacgagacccacuucagcgacgacaucgagcagcaggcggacaacaugaucaccgagaugcugcagaaggaguacauggagcgccaggggaagacgccccugggccucgucgaccuguucguguucuccaccagcuucuaccugaucuccaucuuccugcaccucgugaagaucccgacccaccggcacaucgucggcaagagcugccccaagccccaccgccugaaccacauggggaucugcuccugcgggcuguucaagcagcccggcgugccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5387 - RNA, 1858 nt, Artificial Sequence
  mRNA product Design2 comprising derived and/or modified sequence from Lassa virus__AIT17168__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcugcucaccuuccugcugcucugcggccgcuccugcaccgccagccgguacaagggggucuacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgcgggggacgccgccaaccacugcggcaccgucgccaacggggugcugcagacguucaugcgcauggcguggggcggcagcuacaucgcccucgacuccgggcacggcagcugggacugcaucaugaccuccuaccaguaccugaucauccagaacaccaccugggaggaccacugccaguucagccggcccucccccaucggguaccugggccuccugagccagcgcacgcgggacaucuacaucagccgccggcugcucggcaccuucaccuggacccuguccgacagcgaggggaaggacacgccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggcgauccagcgccugaaggccgaggcccagauguccauccagcugaucaacaaggccgucaacgcccucaucaacgaccagcugaucaugaagaaccaccuccgggacaucauggggauccccuacugcaacuacagcaaguacugguaccucaaccacaccacgaccggcaagaccucccugcccaagugcuggcuggugagcaacggcuccuaccucaacgagacccacuucagcgacgacaucgagcagcaggcggacaacaugaucacggagaugcugcagaaggaguacauggagcgccaggggaagacgccccugggccucguggaccuguucgucuucuccaccagcuucuaccugaucuccaucuuccugcaccucgugaagaucccgacccaccggcacaucgugggcaagagcugccccaagccccaccgccugaaccacauggggaucugcuccugcgggcuguacaagcagcccggcgucccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5388 - RNA, 1858 nt, Artificial Sequence
  mRNA product Design2 comprising derived and/or modified sequence from Lassa virus__AIT17172__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaagcccugcccccggccccaccgccugaaccacaugggcaucugcuccugcgggcuguacaagcagccgggcgugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5389 - RNA, 1858 nt, Artificial Sequence
  mRNA product Design2 comprising derived and/or modified sequence from Lassa virus__AIT17176__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucaucacguuccugcugcucugcggccgcuccugcaccaccaaccuguacaagggggucuacgagcugcaggcccucgagcugaacauggagacccugaacaugacgaugccgcucagcugcaccaagaacaacucccaccacuacaucauggugggcaacgagaccggccuggagcugacccucacgaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgggggccggaucagcgugcaguacaaccugucccacagcuacgcgggggacgccgccucccacugcggcaccaucgccaacgggguccuccagacguucaugcgcauggcguggggcggcagcuacaucgcccuggacuccgggcacggcgggugggacugcaucaugaccagcuaccaguaccugaucauccagaacaccaccugggaggaccacugccaguucucccggcccagccccaucggcuaccucggccugcugucccagcgcacgcgggacaucuacaucagccgccggcuccuggggaccuucaccuggacccugagcgacuccgagggcaaggacacgcccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggcgauccagcgccugaaggccgaggcccagaugagcauccagcucaucaacaaggccgugaacgcccugaucaacgaccagcugaucaugaagaaccaccuccgggacaucaugggcaucccguacugcaacuacuccaaguacugguaccugaaccacaccgucacgggcaagaccagccugcccaagugcuggcucguguccaacgggagcuaccugaacgagacccacuucuccgacgacaucgagcagcaggcggacaacaugaucaccgagaugcugcagaaggaguacauggagcgccagggcaagacgccccucgggcugguggaccuguucgucuucagcaccuccuucuaccugaucagcaucuuccuccaccuggugaagaucccgacccaccggcacguggucggcaagcccugccccaagccccaccgccugaaccacauggggaucugcuccugcggccucuacaagcagccgggcgugcccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5390 - RNA, 1858 nt, Artificial Sequence
  mRNA product Design2 comprising derived and/or modified sequence from Lassa virus__AIT17180__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcagacgcuggagcucaacauggagacccugaacaugaccaugccgcugagcugcaccaagaacaacucccaccacuacauccgggugggcaacgagacgggccucgagcugacccugaccaacaccagcaucaucaaccacaaguucugcaaccucuccgacgcccacaagaagaaccuguacgaccacgcccugaugagcaucaucuccacguuccaccucagcauccccaacuucaaccaguacgaggccauguccugcgacuucaacgggggcaagaucagcguccaguacaaccugucccacagcuacgccggggacgcggccaaccacugcggcaccguggccaacggggugcugcagaccuucaugcgcauggccuggggcggcuccuacaucgcgcucgacagcgggcggggcaacugggacugcaucaugaccuccuaccaguaccugaucauccagaacacgaccugggacgaccacugccaguucagccgccccucccccaucggguaccugggccuccugagccagcggacccgcgacgucuacaucucccggcgccugcucggcaccuucacguggacccugagcgacagcgaggggaaggacaccccgggcggguacugccugacccgguggaugcucaucgaggccgagcugaagugcuucggcaacacggccguggccaagugcaacgagaagcacgacgaggaguucugcgacaugcugcgccucuucgacuucaacaagcaggccauccagcggcugaaggcggaggcccagauguccauccagcugaucaacaaggccgugaacgcccucaucaacgaccagcugaucaugaagaaccaccuccgcgacaucauggggauccccuacugcaacuacagcaaguacugguaccugaacaacaccgccaccggcaagaccucccugcccaagugcuggcugaucagcaacggcuccuaccucaacgagacgcacuucagcgacgacaucgagcaggaggcggacaacaugaucaccgagaugcugcagaaggaguacauggagcggcaggggaagacgccccugggccucgucgaccuguucguguucuccaccagcuucuaccugaucuccaucuuccugcaccucgugaagaucccgacccaccgccacaucgucggcaagagcugccccaagccccaccggcugaaccacauggggaucugcuccugcgggcuguacaagcagcccggcgugccggugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5391 - RNA, 1858 nt, Artificial Sequence
  mRNA product Design2 comprising derived and/or modified sequence from Lassa virus__AIT17184__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucaccuuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgggggacgccgccaaccacugcggcacgguggccaacggggugcugcagaccuucaugcgcauggcguggggcggcuccuacaucgcccucgacagcgggcggaacggcugggacugcaucaugaccuccuaccaguaccugaucauccagaacaccacgugggacgaccacugccaguucagccgccccucccccaucggguaccugggccuccugagccagcggacccgcgacaucuacaucucccggcgccugcucggcaccuucaccuggacgcugagcgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggcgauccggcgccugaaggccgaggcccagauguccauccagcugaucaacaaggccgugaacgcccucaucaacgaccagcugaucaugaagaaccaccuccgggacaucauggggauccccuacugcaacuacagcaaguacugguaccugaacaacacggcgaccggcaagaccucccugccccgcugcuggcuggugagcaacggcuccuaccucaacgagacccacuucagcgacgacaucgagcagcaggccgacaacaugaucacggagaugcugcagcgggaguacauggagcgccaggggaagacgccccugggccucgucgaccuguucguguucuccaccagcuucuaccugaucuccaucuuccugcaccucgugaagaucccgacccaccggcacaucgucgggaagcccugccccaagccccaccgccugaaccacaugggcaucugcagcugcgggcuguacaagcagccgggcgugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5392 - RNA, 1858 nt, Artificial Sequence
  mRNA product Design2 comprising derived and/or modified sequence from Lassa virus__AIT17188__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggcuucguggggcuggucuccuuccugcuccugugcggccgcagcugcacgaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacagcuacgccguggacgcggccaaccacugcgggaccguggccaacggcguccugcagacguucaugcggauggccuggggcggguccuacaucgcgcuggacagcggccacggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaaggacacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccagcggcuccgcgcggaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccacgaccgggcgcaccagccugcccaagugcuggcuggucuccaacggcagcuaccugaacgagacccacuucuccgacgacaucgagcagcaggccgacaacaugaucacggagaugcuccagaaggaguacauggagcggcagggcaagaccccgcuggggcugguggaccucuucguguucagcaccuccuucuaccugaucagcaucuuccugcaccuggucaagaucccgacccaccgccacaucgugggcaaguccugccccaagccccaccggcucaaccacauggggaucugcagcugcggccuguacgggcagcccggcgugccggucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5393 - RNA, 1858 nt, Artificial Sequence
  mRNA product Design2 comprising derived and/or modified sequence from Lassa virus__AIT17192__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggcuucaucgggcugguguccuuccugcuccugugcggccgcagcugcacgaccucccuguacaagggggucuacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguucgaggccauguccugcgacuucaacgggggcaagaucagcgugcaguacaaccucucccacagcuacgccgucgacgcggccaaccacugcgggaccguggccaacggcgugcugcagacguucaugcggauggccuggggcggguccuacaucgcgcuggacagcggccacggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaaggacacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucaugggcauccccuacugcaacuacuccaaguacugguaccugaaccacaccacgaccgggcggaccagccugcccaagugcuggcugguguccaacggcagcuaccugaacgagacccacuucuccgacgacaucgagcagcaggccgacaacaugaucacggagaugcuccagaaggaguacauggagcgccagggcaagaccccgcuggggcuggucgaccucuucguguucagcaccuccuucuaccugaucagcaucuuccugcaccuggugaagaucccgacccaccggcacaucgucggcaaguccugccccaagccccaccgccucaaccacauggggaucugcagcugcggccuguacgggcagcccggcgugccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5394 - RNA, 1858 nt, Artificial Sequence
  mRNA product Design2 comprising derived and/or modified sequence from Lassa virus__AIT17196__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggccggugggacugcaucaugaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugaacauccagcucaucaacaaggccgugaacgcccugaucaacgaccagcugaucaugaagaaccaccuccgcgacaucauggggauccccuacugcaacuacagcaaguacugguaccugaaccacacgaccaccggcaagaccucccugccccggugcuggcucgugagcaacggcuccuaccugaacgagacgcacuucagcgacgacaucgagcagcaggccgacaacaugaucaccgagaugcugcagaaggaguacauggagcgccaggggaagacgccccucggccuggucgaccuguucguguucuccaccagcuucuaccugaucuccaucuuccuccaccuggugaagaucccgacccaccggcacaucgucgggaagcccugccccaagccccaccgccugaaccacaugggcaucugcagcugcggguucuacaagcagccgggcgugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5395 - RNA, 1858 nt, Artificial Sequence
  mRNA product Design2 comprising derived and/or modified sequence from Lassa virus__AIT17204__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccagcucccuguacaaggggguguacgagcugcagacccucgagcugaacauggagacccugaacaugacgaugccgcucagcugcaccaagaacuccagccaccacuacauccgggugggcaacgagaccggccuggagcugacccucacgaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcaccguggccaacggggugcuccagacguucaugcgcauggccuggggcggcagcuacaucgcgcuggacuccgggcacgaccggugggacugcaucaugaccagcuaccaguaccugaucauccagaacaccaccugggaggaccacugccaguucucccgccccagccccaucggcuaccucgggcugcugagccagcggacgcgcgacaucuacaucucccggcgccuccugggcaccuucaccuggacccugagcgacuccgagggcaaggacacgcccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcaucccguacugcaacuacuccaaguacugguaccugaaccacaccaucacggggaagaccagccugcccaagugcuggcucguguccaacggcagcuaccugaacaagacccacuucuccgacgacaucgagcagcaggccgacaacaugaucaccgagaugcugcagaaggaguacauggagcggcagggcaagacgccccucgggcuggucgaccuguucguguucagcaccuccuucuaccugaucagcaucuuccuccaccugaucaagaucccgacccaccgccacaucgugggcaagcccugccccaagccccaccggcugaaccacauggggaucugcuccugcggccucuacaagcagccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5396 - RNA, 1858 nt, Artificial Sequence
  mRNA product Design2 comprising derived and/or modified sequence from Lassa virus__AIT17208__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggccagugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5397 - RNA, 1858 nt, Artificial Sequence
  mRNA product Design2 comprising derived and/or modified sequence from Lassa virus__AIT17210__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcgaccggugggacugcaucaugaccagcuaccaguaccugaucauccagaacaccacgugggaggaccacugccaguucucccgccccagccccaucggcuaccucgggcugcugucccagcggacccgcgacaucuacaucagccggcgccuccugggcaccuucaccuggacgcugagcgacuccgagggcaaggacacccccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcauccccuacugcaacuacuccaaguacugguaccugaaccacacgaccaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcagggcaagaccccgcucgggcuggucgaccuguucguguucagcaccuccuucuaccugaucagcaucuuccuccgccuggugaagaucccgacgcaccggcacaucgucggcaagcccugccccaagccccaccgccugaaccacauggggaucugcuccugcggccucuacaagcagccgggggugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5398 - RNA, 1858 nt, Artificial Sequence
  mRNA product Design2 comprising derived and/or modified sequence from Lassa virus__AIT17212__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccaccggaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcgcauggccuggggcggcagcuacaucgcgcuggacuccgggcggggcaagugggacugcaucaugaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucauggggauccccuacugcaacuacuccaaguacugguaccugaaccacacgaccaccggcaagaccagccugccccggugcuggcucguguccaacggcagcuaccugaacgagacgcacuucuccgacgacaucgagcagcaggccgacaacaugaucaccgagaugcugcagaaggaguacauggagcgccaggggaagacgccccucggccuggucgaccuguucguguucagcaccuccuucuaccugaucagcaucuuccuccaccuggugaagaucccgacccaccggcacaucgucgggaagcccugccccaagccccaccgccugaaccacaugggcaucugcuccugcgggcucuacaagcagccgggcgugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5399 - RNA, 1858 nt, Artificial Sequence
  mRNA product Design2 comprising derived and/or modified sequence from Lassa virus__AIT17216__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggccgcugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugccccaagccccaccgccugaacuacaugggcaucugcuccugcgggcuguacaagcagccgggcgugcccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5400 - RNA, 1858 nt, Artificial Sequence
  mRNA product Design2 comprising derived and/or modified sequence from Lassa virus__AIT17224__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgacaccggccucgagcugacgcugaccaacaccagcaucauccagcacaaguucugcaaccucuccgacgcccacaagaagaaccuguacgaccacacccugaugagcaucaucuccacguuccaccucagcauccccaacuucaaccaguacgaggccauguccugcgacuucaacgggggcaagaucagcguccaguacaaccugucccacagcuacgccggggacgcggccucccacugcggcaccguggccaacggggugcugcagaccuucaugcgcauggccuggggcggcagcuacaucgcgcucgacuccgggcggggcaacugggacugcaucaugaccagcuaccaguaccugaucauccagaacacgaccugggaggaccacugccaguucucccgccccagccccaucggguaccugggccuccugucccagcggacccgcgacaucuacaucagccggcgccugcucggcaccuucacguggacccugagcgacuccgaggggcgggacaccccgggcggguacugccugacccgcuggaugcucaucgaggccgagcugaagugcuucggcaacacggccgucgccaagugcaacgagaagcacgacgaggaguucugcgacaugcugcggcuguucgacuucaacaagcaggccauccagcgccugaagaccgaggcgcagaugagcauccagcugaucaacaaggccgugaacgcccucaucaacgaccagcugaucaugaagaaccaccuccgggacaucauggggauccccuacugcaacuacuccaaguacugguaccucaacaacaccaucaccggcaagagcucccugcccaagugcuggcuggugagcaacggcuccuaccucaacgagacgcacuucagcgacgacaucgagcaggaggccgacaacaugaucaccgagaugcugcagaaggaguacauggagcgccaggggaagacgccccugggccucgucgaccuguucguguucuccaccagcuucuaccugaucuccaucuuccugcaccucgugaagaucccgacccaccggcacaucgucgggaagcccugccccaagccccaccgccugaaccacaugggcgugugcagcugcgggcuguacaagcagccgggcgugcccguccgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5401 - RNA, 1858 nt, Artificial Sequence
  mRNA product Design2 comprising derived and/or modified sequence from Lassa virus__AIT17228__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcugcucacguuccugcugcucugcggccgcuccugcaccaccagccuguacaagggggucuacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccggggacgcggccaaccacugcggcacggucgccaacggggugcuccagaccuucaugcggauggccuggggcggcagcuacaucgcgcuggacuccgggcgcggcgggugggacugcaucaugaccagcuaccaguaccugaucauccagaacaccacgugggaggaccacugccaguucucccggcccagccccaucggcuaccucggccugcugucccagcgcacccgggacaucuacaucagccgccggcuccuggggaccuucaccuggacgcugagcgacuccgagggcaaggacacccccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaaggcggaggcccagaugagcauccagcucaucaacaaggccgucaacgcccugaucaacgaccagcugaucaugaagaaccaccuccgggacaucaugggcauccccuacugcaacuacuccaaguacugguaccugaaccacacgaccaccggcaagaccagccugcccaagugcuggcucguguccaacgggagcuaccugaacgagacgcacuucuccgacgacaucgagcagcaggccgacaacaugaucaccgagaugcugcagaaggaguacauggagcgccagggcaagaccccgcucgggcugguggaccuguucgucuucagcaccuccuucuaccugaucagcaucuuccuccaccuggugaagaucccgacgcaccggcacaucgugggcaaguccugccccaagccccaccgccugaaccacauggggaucugcagcugcggccucuacaagcagcccggcgucccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5402 - RNA, 1858 nt, Artificial Sequence
  mRNA product Design2 comprising derived and/or modified sequence from Lassa virus__AIT17232__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgaggggaagaucuccguccaguacaaccugagccacuccuacgccggcgacgcggccaaccacugcgggacgguggccaacggcgugcugcagaccuucaugcgcauggccuggggcgggagcuacaucgcgcucgacuccggccgggggaagugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccaucgagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaaguccugccccaagccccaccggcugaaccacauggggaucugcagcugcggccuguacaagcagcccggggugccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5403 - RNA, 1858 nt, Artificial Sequence
  mRNA product Design2 comprising derived and/or modified sequence from Lassa virus__AIT17236__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggccggaucuccguccaguacaaccugagccacuccuacgccggggaggcggccaaccacugcggcacgguggccaacggggugcugcagaccuucaugcgcauggccuggggcggcagcuacaucgcgcucgacuccgggcggggcaagugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacucccgguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaaguccugccccaagccccaccgccugaaccacaugggcaucugcagcugcgggcuguacaagcagcccggcgugccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5404 - RNA, 1858 nt, Artificial Sequence
  mRNA product Design2 comprising derived and/or modified sequence from Lassa virus__AIT17240__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaagggguucuacgagcugcagacccucgagcugaacauggagacgcugaacaugaccaugccgcucuccugcaccaagaacaacagccaccacuacauccgggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccggggacgcggccaaccacugcggcacggucgccaacggggugcuccagaccuucaugcgcauggccuggggcggcagcuacaucgcgcuggacuccgggcggggccgcugggacugcaucaugaccagcuaccaguaccugaucauccagaacaccacgugggaggaccacugccaguucucccggcccagccccaucggguaccucggccugcugucccagaagacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccauccagcggcugaaggcggaggcccagaugagcauccagcucaucaacaaggccgucaacgcccugaucaacgaccagcugaucaugaagaaccaccuccgcgacaucauggggauccccuacugcaacuacuccaaguacugguaccugaaccacacgaccaccggcaagaccagccugcccaagugcuggcucguguccaacggcagcuaccugaacgagacgcacuucuccgacgacaucgagcagcaggccgacaacaugaucaccgagaugcugcagaaggaguacauggagcggcaggggaagacgccccucggccugguggaccuguucgucuucagcaccuccuucuaccugaucagcaucuuccuccaccuggugaagaucccgacccaccgccacaucguggggaaguccugccccaagccccaccggcugaaccacaugggcaucugcagcugcgggcucuacaagcagcccggcgucccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5405 - RNA, 1858 nt, Artificial Sequence
  mRNA product Design2 comprising derived and/or modified sequence from Lassa virus__AIT17244__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucaccuuccugcugcucugcggccgcuccugcaccaccaaccuguacaaggggguguacgagcugcagacccucgagcugaacauggagacgcugaacaugaccaugccgcucagcugcaccaagaacuccagccaccacuacauccgggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgugggggacgccgcggaccacugcggcacgguggccaacgggguccuccagaccuucaugcgcauggccuggggcggcagcuacaucgcccuggacuccgggcggggcaagugggacugcaucaucaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggcggagcugaagugcuucggcaacaccgccguggccaagugcaacgagaagcacgacgaggaguucugcgacaugcuccgccuguucgacuucaacaagcaggccauccagcggcugaaggccgaggcgcagaugagcauccagcucaucaacaaggccgugaacgcccugaucaacgaccagcugaucaugaagaaccaccuccgcgacaucauggggauccccuacugcaacuacuccaaguacugguaccugaaccacacgaucaccggcaagaccagccugccccggugcuggcucgucuccaacggcagcuaccugaacgagacccgcuucuccgacgacaucgagcagcaggccgacaacaugaucacggagaugcugcagaaggaguacauggagcggcaggggaagacgccccucggccugguggaccuguucguguucagcaccuccuucuaccugaucagcaucuuccuccaccuggucaagaucccgacccaccgccacaucguggggaagcccugccccaagccccaccggcugaaccacaugggcaucugcuccugcgggcucuacaagcagccgggcgugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5406 - RNA, 1858 nt, Artificial Sequence
  mRNA product Design2 comprising derived and/or modified sequence from Lassa virus__AIT17246__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucaucacguuccugcugcucugcggccgcuccugcaccaccaaccuguacaagggggucuacgagcugcagacccucgagcugaacauggagacgcugaacaugaccaugccgcucagcugcaccaagaacuccagccaccacuacaucauggugggcaacgagaccggccuggagcugacgcucaccaacaccuccaucaucaaccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccgugcaguacaaccugagccacuccuacgccgucgacgccgcgaaccacugcgggaccguggccaacggcauccuccagaccuucaugcggauggccuggggcgggagcuacaucgcccuggacuccggccgcgggaacugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagaugagcauccagcucaucaacaaggccgucaacgcccugaucaacgaccagcugaucaugaagaaccaccuccgggacaucaugggcauccccuacugcaacuacuccaaguacugguaccugaaccacaccaccaccgggaagacgagccugcccaagugcuggcucguguccaacggcagcuaccugaacgagacccacuucuccgacgacaucgagcagcaggccgacaacaugaucaccgagaugcugcagaaggaguacauggagcgccagggcaagaccccgcucgggcugguggaccuguucgucuucagcacguccuucuaccugaucagcaucuuccuccaccuggugaagaucccgacccaccggcacaucgugggcaagcccugccccaagccccaccgccugaaccacauggggaucugcuccugcggccucuacaagcagccggggguccccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5407 - RNA, 1858 nt, Artificial Sequence
  mRNA product Design2 comprising derived and/or modified sequence from Lassa virus__AIT17250__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacacccucaugagcaucaucuccacguuccaccugagcauccccaacuucaaccaguacgaggccauguccugcgacuucaacgggggcaagaucagcguccaguacaaccugucccacagcuacgccguggacgccgcgaaccacugcgggaccguggccaacggcguccuccagaccuucaugcggauggccuggggcggguccuacaucgcccuggacagcggccgcgggaacugggacugcaucaugaccuccuaccaguaccugaucauccagaacacgaccugggaggaccacugccaguucagccggcccucccccaucggcuaccucgggcugcugagccagcgcacccgggacaucuacaucucccgccggcuccugggcaccuucacguggacccugagcgacagcgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagauguccauccagcucaucaacaaggccgugaacgcccugaucaacgaccagcugaucaugaagaaccaccuccgggacaucaugggcauccccuacugcaacuacagcaaguacugguaccugaaccacaccaccaccgggaagacgucccugcccaagugcuggcucgucagcaacggcuccuaccugaacgagacccacuucagcgacgacaucgagcagcaggccgacaacaugaucaccgagaugcugcagaaggaguacauggagcgccagggcaagaccccgcucgggcugguggaccuguucguguucuccacgagcuucuaccugaucuccaucuuccuccaccuggucaagaucccgacccaccggcacaucgugggcaagcccugccccaagccccaccgccugaaccacauggggaucugcagcugcggccucuacaagcagccgggggugcccguccgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5408 - RNA, 1858 nt, Artificial Sequence
  mRNA product Design2 comprising derived and/or modified sequence from Lassa virus__AIT17254__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggcaucguggggcuggucacguuccugcuccugugcggccgcuccugcaccaccagccuguacaaggggguguacgagcuccagacccuggagcugaacauggagacgcucaacaugaccaugccgcuguccugcaccaagaacaacagccaccacuacaucauggugggcaacgagaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccggggacgcggccaaccacugcggcacgguggccaacggggugcugcagaccuucaugcggauggccuggggcggcagcuacaucgcgcuggacuccgggcgcgaccggugggacugcaucaugaccagcuaccaguaccucaucauccagaacaccacgugggaggaccacugccaguucucccgccccagccccaucggcuaccuggggcugcucucccagcggacccgcgacaucuacaucagccggcgccugcugggcaccuucaccuggacgcucagcgacuccgagggcaagaacacccccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggccauccagcggcucaaggcggaggcccagaugagcaucucccugaucaacaaggccgugaacgcccugaucaacgaccagcucaucaugaagaaccaccuccgcgacaucaugggcauccccuacugcaacuacagcaaguacugguaccugaaccacacgaccaccgggaagaccucccugccccggugcuggcuggugagcaacggcuccuaccugaacgagacgcacuucagcgacgacaucgagcagcaggccgacaacaugaucaccgagaugcuccagaaggaguacauggaccgccagggcaagaccccgcuggggcuggucgaccucuucguguucuccaccagcuucuaccugaucuccaucuuccugcaccuggugaagaucccgacgcaccggcacaucgucggcaagaccugccccaagccccaccgccucaaccacauggggaucugcagcugcggccuguacaagcagcccggggugccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5409 - RNA, 1858 nt, Artificial Sequence
  mRNA product Design2 comprising derived and/or modified sequence from Lassa virus__AIT17258__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacaucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucgucagcaccuuccaccucuccauccccaacuucaaccaguacgaggccaugagcugcgacuucaacgggggcaagaucuccgugcaguacaaccugagccacuccuacgccguggacgcggccaaccacugcgggacggucgccaacggcgugcugcagaccuucaugcggauggccuggggcgggagcuacaucgcgcucgacuccggccgcgggggcugggacugcaucaugaccagcuaccaguaccugaucauccagaacgugaccugggaggaccacugccaguucucccggcccagccccaucggguaccugggccuccugucccagcgcacgcgggacgucuacaucagccgccggcugcucggcaccuucaccuggacccugagcgacuccgaggggaacgacacgccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacaccacgaccggcaagaccagccugcccaagugcuggcuggucuccaacggcagcuaccucaacgagacccacuucuccgacgacaucgagcagcaggccgacaacaugaucacggagaugcugcagaaggaguacauggagcgccaggggaagacgccccugggccucguggaccuguucguguucagcaccuccuucuaccugaucagcaucuuccugcaccucgucaagaucccgacccaccggcacaucguggggaagcccugccccaagccccaccgccugaaccacaugggcaucugcuccugcgggcuguacaagcagccgggcgugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5410 - RNA, 1858 nt, Artificial Sequence
  mRNA product Design2 comprising derived and/or modified sequence from Lassa virus__AIT17262__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccacgcacugcggcaccguggccaacggggugcuccagaccuucaugcggauggccuggggcggcagcuacaucgcgcuggacuccgggcgcggcaagugggacugcaucaugaccagcuaccaguaccugaucauccagaacacgaccugggaggaccacugccaguucucccggcccagccccaucggguaccucggccugcugucccagcgcacccgggacaucuacaucagccgccggcuccugggcaccuucacguggacccugagcgacuccgaggggaaggacaccccgggcggguacugccucacccgcuggaugcugaucgaggccgagcugaagugcuucggcaacacggccgucgccaagugcaacgagaagcacgacgaggaguucugcgacaugcuccggcuguucgacuucaacaagcaggccauccagcgccugaagaccgaggcgcagaugagcauccagcucaucaacaaggccgugaacgcccugaucaacgaccagcugaucaugaagaaccaccuccgggacaucauggggauccccuacugcaacuacuccaaguacugguaccugaaccacaccaccacgggcaagaccagccugccccgcugcuggcucguguccaacggcagcuaccugaacgagacccacuucuccgacgacaucgagcagcaggccgacaacaugaucaccgagaugcugcagaaggaguacauggagcggcaggggaagacgccccucggccuggucgaccuguucguguucagcaccuccuucuaccugaucagcaucuuccuccaccuggugaagaucccgacccaccgccacaucgucgggaagcccugccccaagccccaccggcugaaccacaugggcaucugcuccugcgggcucuacaagcagccgggcgugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5411 - RNA, 1858 nt, Artificial Sequence
  mRNA product Design2 comprising derived and/or modified sequence from Lassa virus__AIT17266__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccucccugaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccaaccacugcgggacgguggccaacggcguccugcagaccuucaugcggauggccuggggcgggagcuacaucgcgcuggacuccggccgcgggggcugggacugcaucaugaccagcuaccaguaccucaucauccagaacaccacgugggaggaccacugccaguucucccggcccagccccaucggguaccugggccugcucucccagcgcacccgggacaucuacaucagccgccggcugcugggcaccuucaccuggacgcucagcgacuccgaggggaaggacaccccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggccauccagcgccucaaggcggaggcccagaugagcauccagcugaucaacaaggccgugaacgcccugaucaacgaccagcucaucaugaagaaccaccuccgggacaucauggggauccccuacugcaacuacuccaaguacugguaccugaaccacacgaccaccggccgcaccagccugccccggugcuggcuggucuccaacggcagcuaccugaacgagacgcacuucuccgacgacaucgagcagcaggccgacaacaugaucaccgagaugcuccagaaggaguacauggagcgccaggggaagacgccccugggccugguggaccuguucguguucagcaccuccuucuaccucaucagcaucuuccugcaccuggucaagaucccgacccaccggcacaucguggggaaguccugccccaagccccaccgccucaaccacaugggcaucugcagcugcgggcuguacaagcagcccggcgugccggucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5412 - RNA, 1858 nt, Artificial Sequence
  mRNA product Design2 comprising derived and/or modified sequence from Lassa virus__AIT17270__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugaccuuccuccugcugugcggccgcuccugcagcaccuccguguacaagggggucuacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacagcuacgccgucgacgcggccaaccacugcgggaccguggccaacggcgugcugcagacguucaugcggauggccuggggcggguccuacaucgcgcuggacagcggccacgggggcugggacugcaucaugaccaacuaccaguaccucaucauccagaacaccaccugggaggaccacugccaguucucccgccccagccccaucggguaccugggccugcucucccagcggacgcgcgacaucuacaucagccggcgccugcugggcaccuucaccuggacccucagcgacuccgaggggaaggacacgccgggcggguacugccugacccgguggaugcugaucgaggccgagcucaagugcuucggcaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacaccacgaccggccggaccagccugcccaagugcuggcugguguccaacggcagcuaccugaacgagacccacuucuccgacgacaucgagcagcaggccgacaacaugaucacggagaugcuccagcgcgaguacauggagcggcaggggaagacgccccugggccuggucgaccucuucguguucagcaccuccuucuaccugaucagcaucuuccugcaccuggugaagaucccgacccaccgccacaucgucgggaaguccugccccaagccccaccggcucaaccacaugggcaucugcagcugcgggcuguacaagcagcccggcgugccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5413 - RNA, 1858 nt, Artificial Sequence
  mRNA product Design2 comprising derived and/or modified sequence from Lassa virus__AIT17274__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacguggcgaccugcggccugacggggcuggucgccuuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucgagcaccgcuucugcaaccucuccgacgcccacaagaagaaccuguacgaccacgcccugaugagcaucaucuccaccuuccaccucagcauccccaacuucaaccaguacgaggcgauguccugcgacuucaacgggggcaagaucagcguccaguacaaccugucccacagcuacgccguggacgccgccaaccacugcgggacgguggcgaacggcguccugcagaccuucaugcggauggccuggggcggguccuacaucgcccucgacagcggccgcaacgggugggacugcaucaugaccuccuaccaguaccugaucauccagaacaccacgugggaggaccacugccaguucagccggcccucccccaucggcuaccuggggcuccugagccagcgcacccgggacaucuacaucucccgccggcugcucggcaccuucaccuggacgcugagcgacagcgagggcaaggacacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgccugaaggccgaggcccagauguccauccagcugaucaacaaggccgugaacgcgcucaucaacgaccagcugaucaugaagaaccaccuccgggacaucaugggcauccccuacugcaacuacagcaaguacugguaccucaacaacacggccaccgggaagaccucccugccccgcugcuggcuggucagcaacggcuccuaccucaacgagacccacuucagcgacgacaucgagcagcaggccgacaacaugaucacggagaugcugcagaaggaguacauggagcggcagggcaagaccccgcuggggcucguggaccuguucguguucuccaccagcuucuaccugaucuccaucuuccugcaccucgucaagaucccgacccaccgccacaucgugggcaagcccugccccaagccccaccggcugaaccacauggggaucugcagcugcggccuguacaagcagccgggggcccccgugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5414 - RNA, 1858 nt, Artificial Sequence
  mRNA product Design2 comprising derived and/or modified sequence from Lassa virus__AIT17276__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggcaagugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcgggcuguacaagcagcccggcgugccggugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5415 - RNA, 1855 nt, Artificial Sequence
  mRNA product Design2 comprising derived and/or modified sequence from Lassa virus__AIT17280__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucgaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcgcauggccuggggcggcagcuacaucgcgcucgacuccgggcacgagugggacugcaucaugaccagcuaccaguaccugaucauccagaacaccacgugggacaaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaagguggaggcgcagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcuggucuccaacggcagcuaccucaacgagacgcacuucuccgacgacaucgagcagcaggccgacaacaugaucaccgagaugcugcagaaggaguacauggagcgccagggcaagaccccgcuggggcucguggaccuguucguguucagcaccuccuucuaccugaucagcaucuuccugcaccucgucaagaucccgacgcaccggcacaucgugggcaaguccugccccaagccccaccgccugaaccacauggggaucugcagcugcggcuucuacaagcagcccggggugccggucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5416 - RNA, 1858 nt, Artificial Sequence
  mRNA product Design2 comprising derived and/or modified sequence from Lassa virus__AIT17288__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccguggacgcggccaaccacugcgggacgguggccaacggcguccugcagaccuucaugcggauggccuggggcgggggcuacaucgcgcucgacagcgggcgcggcaacugggacugcaucaugaccuccuaccaguaccugaucauccagaacaccacgugggaggaccacugccaguucagccggcccucccccaucggguaccugggccuccugagccagcgcacccgggacaucuacaucucccgccggcugcucggcaccuucaccuggacgcugagcgacagcgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagauguccauccagcugaucaacaaggccgugaacgcccucaucaacgaccagcugaucaugaagaaccaccuccgggacaucauggggauccccuacugcaacuacagcaaguacugguaccucaaccacacggucaccggcaagaccucccugcccaagugcuggcuggugagcaacggcuccuaccucaacgagacccacuucagcgacgacaucgagcagcaggccgacaacaugaucacggagaugcugcagaaggaguacauggagcgccaggggaagacgccccugggccucguggaccuguucgucuucuccaccagcuucuaccugaucuccaucuuccugcaccucgugaagaucccgacccaccggcacaucgugggcaagagcugccccaagccccaccgccugaaccacauggggaucugcuccugcgggcuguacaagcagcccggcgucccggugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5417 - RNA, 1858 nt, Artificial Sequence
  mRNA product Design2 comprising derived and/or modified sequence from Lassa virus__AIT17292__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcaucauggccgugcugaaggggcuguacaacaucgcgaccugcggccucguggggcuggucacguuccugcuccugugcggccgcuccugcaccaccacccuguacaaggggguguacgagcuccagacgcuggagcugaacauggagacccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcguccaguacaaccucucccacagcuacgccggggacgcggccaaccacugcggcaccguggccaacggggugcugcagaccuucaugcggauggccuggggcggcuccuacaucgcgcuggacagcgggcacggcgggugggacugcaucaugaccuccuaccaguaccucaucauccagaacacgaccugggaggaccacugccaguucacccgccccagccccaucggcuaccugggccugcucucccagcggacccgcgacaucuacaucagccggcgccugcuggggacguucaccuggacccucuccgacagcgagggcaacgacacccccgggggcuacugccugacgcgguggaugcugaucgaggccgagcucaagugcuucgggaacaccgccgucgccaagugcaacgagaagcacgacgaggaguucugcgacaugcugcgccuguucgacuucaacaagcaggccauccagcggcuccgcgcggaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccaccacgggccgcaccagccugccccggugcuggcugguguccaacgggagcuaccugaacgagacccacuucuccgacgacaucgagcagcaggccgacaacaugaucaccgagaugcuccagaaggaguacauggagcgccagggcaagacgccccuggggcuggucgaccucuucguguucagcaccuccuucuaccugaucagcaucuuccugcaccugaucaagaucccgacccaccggcacaucgugggcaagcccugccccaagccccaccgccucaaccacaugggggucugcuccugcggccuguacaagcagccgggcgugcccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5418 - RNA, 1858 nt, Artificial Sequence
  mRNA product Design2 comprising derived and/or modified sequence from Lassa virus__AIT17294__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggcgggugggacugcaucaugaccagcuaccaguaccugaucauccagaacaccacgugggaggaccacugccaguucucccggcccagccccgucggcuaccucggccugcugucccagcgcacccgggacaucuacaucagccgccggcuccuggggaccuucaccuggacgcugagcgacuccgagggcaaggacacccccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaagacggaggcgcagaugagcauccagcucaucaacaaggccgugaacgcccugaucaacgaccagcugaucaugaagaaccaccuccgggacaucaugggcauccccuacugcaacuacuccaaguacugguaccugaaccacaccaccaccggcaagacgagccugccccgcugcuggcucgucuccaacgggagcuaccugaacgagacccacuucuccgacgacaucgagcagcaggccgacaacaugaucaccgagaugcugcagaaggaguacauggagcggcagggcaagaccccgcucgggcugguggaccuguucguguucagcacguccuucuaccugaucagcaucuuccuccaccuggucaagaucccgacccaccgccacaucgugggcaagcccugccccaagccccaccggcugaaccacauggggaucugcuccugcggccucuacaagcagccgggcgugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5419 - RNA, 1858 nt, Artificial Sequence
  mRNA product Design2 comprising derived and/or modified sequence from Lassa virus__AIT17298__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacaucgcgaccugcggccugcuggggcucgugugcuuccugcugcucugcggccgcuccugcaccaccagccuguacaagggggucuacgagcugcagacccucgagcugaacauggagacccugaacaugacgaugccgcucuccugcaccaagaacaacagccaccacuacaucauggugggcaacgagaccggccuggagcugacccucacgaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccgucgacgcggccagccacugcgggaccaucgccaacggcgugcuccagacguucaugcggauggccuggggcggguccuacaucgcgcuggacagcggccacgggggcugggacugcaucaugaccuccuaccaguaccugaucauccagaacaccaccugggaggaccacugccaguucagccgccccucccccaucggguaccucggccugcugagccagcggacgcgcgacaucuacaucagccggcgccuccugggcaccuucaccuggacccuguccgacagcgaggggaaggacacgccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccauccagcggcugaaggcggaggcccagauguccauccagcucaucaacaaggccgucaacgcccugaucaacgaccagcugaucaugaagaaccaccuccgcgacaucauggggauccccuacugcaacuacagcaaguacugguaccugaaccacaccacgaccggcaagaccucccugcccaagugcuggcucgugagcaacggcuccuaccugaacgagacccacuucagcgacgacaucgagcagcaggccgacaacaugaucacggagaugcugcagaaggaguacauggagcggcaggggaagacgccccucggccugguggaccuguucgucuucuccaccagcuucuaccugaucuccaucuuccuccaccuggugaagaucccgacccaccgccacguggucgggaagcccugccccaagccccaccggcugaaccacaugggcaucugcagcugcgggcucuacggccagccgggcgugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5420 - RNA, 1858 nt, Artificial Sequence
  mRNA product Design2 comprising derived and/or modified sequence from Lassa virus__AIT17302__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucucccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccguccaguacaaccugagccacuccuacgccguggacgccgcgaaccacugcgggaccguggccaacggcguccuccagaccuucaugcggauggccuggggcgggagcuacaucgcccuggacuccggccgcgggaacugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagaugagcauccagcucaucaacaaggccgugaacgcccugaucaacgaccagcugaucaugaagaaccaccuccgggacaucaugggcauccccuacugcaacuacuccaaguacugguaccugaaccacaccaccaccgggaagacgagccugcccaagugcuggcucgucuccaacggcagcuaccugaacgagacccacuucuccgacgacaucgagcagcaggccgacaacaugaucaccgagaugcugcagaaggaguacauggagcgccagggcaagaccccgcucgggcugguggaccuguucguguucagcacguccuucuaccugaucagcaucuuccuccaccuggucaagaucccgacccaccggcacaucgugggcaagcccugccccaagccccaccgccugaaccacauggggaucugcuccugcggccucuacaagcagccgggggugcccguccgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5421 - RNA, 1858 nt, Artificial Sequence
  mRNA product Design2 comprising derived and/or modified sequence from Lassa virus__AIT17310__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccacgcacugcggcaccguggccaacggggugcuccagaccuucaugcggauggccuggggcggcagcuacaucgcgcuggacuccgggcgcggcaagugggacugcaucaugaccagcuaccaguaccugaucauccagaacacgaccugggaggaccacugccaguucucccggcccagccccaucggguaccucggccugcugucccagcgcacccgggacaucuacaucagccgccggcuccugggcaccuucacguggacccugagcgacuccgaggggaaggacaccccgggcggguacugccucacccgcuggaugcugaucgaggccgagcugaagugcuucggcaacacggccgucgccaagugcaacgagaagcacgacgaggaguucugcgacaugcuccggcuguucgacuucaacaagcaggccauccagcgccugaagaccgaggcgcagaugagcauccagcucaucaacaaggccgugaacgcccugaucaacgaccagcugaucaugaagaaccaccuccgggacaucauggggauccccuacugcaacuacuccaaguacugguaccugaaccacaccaccacgggcaagaccagccugccccgcugcuggcucguguccaacggcagcuaccugaacgagacccacuucuccgacgacaucgagcagcaggccgacaacaugaucaccgagaugcugcagaaggaguacauggagcggcaggggaagacgccccucggccuggucgaccuguucguguucagcaccuccuucuaccugaucagcaucuuccuccaccuggugaagaucccgacccaccgccacaucgucgggaagcccugccccaagccccaccggcugaacuacaugggcaucugcuccugcgggcucuacaagcagccgggcgugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5422 - RNA, 1858 nt, Artificial Sequence
  mRNA product Design2 comprising derived and/or modified sequence from Lassa virus__AIT17314__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucacccucagcauccuggccgugcugaaggggcucuacaacguggccacgugcggccuggucgggcuggugaccuuccuccugcugugcggccgcuccugcaccaccagccucuacaaggggguguacgagcugcagacgcuggagcucaacauggagacccugaacaugaccaugccgcuguccugcaccaagaacaacagccaccacuacaucauggucggcaacgagacgggccucgagcugacccugaccaacaccuccaucaucaaccacaaguucugcaaccucagcgacgcgcacaagaaggaccuguacgaccacgcccugauguccaucaucagcacguuccaccucuccauccccaacuucaaccaguacgaggccaugagcugcgacuucaacgggggcaagaucuccgugcaguacaaccugagccacuccuacgccguggacgccgcgaaccacugcgggaccgucgccaacggcgugcugcagaccuucaugcggauggccuggggcgggagcuacaucgcccucgacuccggccgcgggggcugggacugcaucaugaccagcuaccaguaccugaucauccagaacacgaccugggaggaccacugccaguucucccggcccagccccaucggguaccugggccuccugucccagcgcacccgggacaucuacaucagccgccggcugcucggcaccuucacguggacccugagcgacuccgaggggaacgacaccccgggcggguacugccugacccgcuggaugcucaucgaggcggagcugaagugcuucggcaacacggccguggccaagugcaacgagaagcacgacgaggaguucugcgacaugcugcggcuguucgacuucaacaagcaggccauccagcgccugaaggccgaggcgcagaugagcauccagcugaucaacaaggccgucaacgcccucaucaacgaccagcugaucaugaagaaccaccuccgggacaucauggggauccccuacugcaacuacuccaaguacugguaccucaaccacaccaccaccggcaagacgagccugcccaagugcuggcugguguccaacggcagcuaccucaacgagacccacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaagcccugccccaagccccaccgccugaaccacaugggcaucugcuccugcgggcuguacaagcagccgggcguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5423 - RNA, 1858 nt, Artificial Sequence
  mRNA product Design2 comprising derived and/or modified sequence from Lassa virus__AIT17318__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgggggcaagaucagcguccaguacaaccugucccacagcuacgccguggacgcggccaaccacugcgggacgguggccaacggcguccuccagaccuucaugcggauggccuggggcggguccuacaucgcgcuggacagcggccgcgggaacugggacugcaucaugaccuccuaccaguaccugaucauccagaacaucaccugggaggaccacugccaguucagccggcccucccccaucggcuaccucgggcugcugagccagcgcacgcgggacaucuacaucucccgccggcuccugggcaccuucaccuggacccugagcgacagcgagggcaacgacacgcccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaaggcggaggcccagauguccauccagcucaucaacaaggccgugaacgcccugaucaacgaccagcugaucaugaagaaccaccuccgggacaucaugggcauccccuacugcaacuacagcaaguacugguaccugaaccacaccacgaccgggaagaccucccugcccaagugcuggcucgucagcaacggcuccuaccugaacgagacccacuucagcgacgacaucgagcagcaggccgacaacaugaucacggagaugcugcagaaggaguacauggagcgccagggcaagaccccgcucgggcugguggaccuguucguguucuccaccagcuucuaccugaucuccaucuuccuccaccuggucaagaucccgacccaccggcacaucgugggcaagcccugccccaagccccaccgccugaaccacauggggaucugcagcugcggccucuacaagcagccgggggugcccguccgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5424 - RNA, 1858 nt, Artificial Sequence
  mRNA product Design2 comprising derived and/or modified sequence from Lassa virus__AIT17322__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaagggggccuacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacacccucaugagcaucaucuccacguuccaccugagcauccccaacuucaaccaguacgaggccauguccugcgacuucaacgggggcaagaucagcgugcaguacaaccugucccacagcuacgccgucgacgcggccaaccacugcgggaccguggccaacggcgugcuccagaccuucaugcggauggccuggggcggguccuacaucgcgcuggacagcggccgcgggaacugggacugcaucaugaccuccuaccaguaccugaucauccagaacacgaccugggaggaccacugccaguucagccggcccucccccaucggcuaccucgggcugcugagccagcgcacccgggacaucuacaucucccgccggcuccugggcaccuucacguggacccugagcgacagcgagggcaacgacacccccgggggcuacugccucacccgcuggaugcugaucgaggccgagcugaagugcuucgggaacacggccgucgccaagugcaacgagaagcacgacgaggaguucugcgacaugcuccggcuguucgacuucaacaagcaggccauccagcgccugaaggcggaggcccagauguccauccagcucaucaacaaggccgugaacgcccugaucaacgaccagcugaucaugaagaaccaccuccgggacaucaugggcauccccuacugcaacuacagcaaguacugguaccugaaccacaccaccaccgggaagacgucccugcccaagugcuggcucgugagcaacggcuccuaccugaacgagacccacuucagcgacgacaucgagcagcaggccgacaacaugaucaccgagaugcugcagaaggaguacauggagcgccagggcaagaccccgcucgggcuggucgaccuguucguguucuccacgagcuucuaccugaucuccaucuuccuccaccuggugaagaucccgacccaccggcacaucgucggcaagcccugccccaagccccaccgccugaaccacauggggaucugcagcugcggccucuacaagcagccgggggugcccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5425 - RNA, 1858 nt, Artificial Sequence
  mRNA product Design2 comprising derived and/or modified sequence from Lassa virus__AIT17328__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucacccucagcauccuggccgugcugaaggggcucuacaacaucgccacgugcggccugguggggcuggucaccuuccuccugcugugcggcaaguccugcaccaccagccucuacaaggggguguacgagcugcagacgcuggagcucaacauggagacccugaacaugaccaugccgcuguccugcaccaagaacaacagccaccacuacauccgcgugggcaacgagacgggccucgagcugacccugaccaacaccuccaucaucaaccacaaguucugcaaccucagcgacgcgcacaagaagaaccuguacgaccacgcccugauguccaucaucagcacguuccaccucuccauccccaacuucaaccaguacgaggccaugagcugcgacuucaacgggggcaagaucuccguccaguacaaccugagccacuccuacgccguggacgccgcgaaccacugcgggaccguggccaacggcguccugcagaccuucaugcggauggccuggggcgggagcuacaucgcccucgacuccggccacgggaacugggacugcaucaugaccagcuaccaguaccugaucauccagaacacgaccugggaggaccacugccaguucucccgccccagccccaucggcuaccuggggcuccugucccagcggacccgcgacaucuacaucagccggcgccugcucggcaccuucacguggacccugagcgacuccgagggcaacgacgcgcccgggggcuacugccugacccgguggaugcucaucgaggccgagcugaagugcuucgggaacaccgccguggccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcuggucuccaacggcagcuaccucaacgagacgcacuucuccgacgacaucgagcagcaggccgacaacaugaucaccgagaugcugcagaaggaguacauggagcggcagggcaagaccccgcuggggcucguggaccuguucguguucagcaccuccuucuaccugaucagcaucuuccugcaccucgucaagaucccgacgcaccgccacguggugggcaaguccugccccaagccccaccggcugaaccacauggggaucugcagcugcggccuguacaagcagcccggggucccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5426 - RNA, 1858 nt, Artificial Sequence
  mRNA product Design2 comprising derived and/or modified sequence from Lassa virus__AIT17332__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacauccgggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccguggacgcggccaaccacugcgggacgguggccaacggcguccuccagaccuucaugcgcauggccuggggcgggagcuacaucgcgcuggacuccggccacgggcggugggacugcaucaugaccagcuaccaguaccugaucauccagaacaccacgugggaggaccacugccucuucucccgccccagccccaucggcuaccuggggcugcucucccagcggacccgcgacaucuacaucagccggcgccugcugggcaccuucaccuggacgcucagcgacuccgagggccgggacacccccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggccauccagcgccucaaggcggaggcccagaugagcauccagcugaucaacaaggccgugaacgcccugaucaacgaccagcucaucaugaagaaccaccuccgggacaucaugggcauccccuacugcaacuacuccaaguacugguaccugaaccacacgaccaccgggcgcaccagccugccccggugcuggcuggucuccaacggcagcuaccugaacgagacgcacuucuccgacgacaucgagcagcaggccgacaacaugaucaccgagaugcuccagaaggaguacauggagcgccagggcaagaccccgcuggggcugguggaccuguucguguucagcaccuccuucuaccucaucagcaucuuccugcaccuggucaagaucccgacgcaccggcacaucgugggcaaguccugccccaagccccaccgccucaaccacauggggaucugcagcugcggccuguacaagcagcccggggugccggucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5427 - RNA, 1858 nt, Artificial Sequence
  mRNA product Design2 comprising derived and/or modified sequence from Lassa virus__AIT17340__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaucuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcggcgagugggacugcaucaugaccagcuaccaguaccugaucauccagaacaccaccugggaggaccacugccaguucucccggcccagccccaucggguaccugggccuccugucccagcgcacgcgggacaucuacaucagccgccggcugcucggcaccuucaccuggacccugagcgacuccgaggggaaggacacgccgggcggguacugccugacccgcuggaugcucaucgaggccgagcugaagugcuucggcaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacaccacgaccggcaagaccagccugcccaagugcuggcugguguccaacggcagcuaccucaacgagacccacuucuccgacgacaucgagcagcaggccgacaacaugaucacggagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugcccccgcccccaccggcugaaccacaugggcaucugcuccugcgggcuguacaagcagccgggcgugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5428 - RNA, 1858 nt, Artificial Sequence
  mRNA product Design2 comprising derived and/or modified sequence from Lassa virus__AIT17344__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacaaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccagccacugcggcacgguggccaacggggugcugcagaccuucaugcggauggccuggggcggcuccuacaucgcgcucgacagcggguacggcaagugggacugcaucaugaccuccuaccaguaccugaucauccagaacaccacgugggaggaccacugccaguucagccgccccucccccaucggguaccugggccuccugagccagcggacccgcgacaucuacaucagccggcgccugcucggcaccuucaccuggacgcuguccgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaagacggaggcgcagauguccauccagcugaucaacaaggccgugaacgcccucaucaacgaccagcugaucaugaagaaccaccuccgcgacaucauggggauccccuacugcaacuacagcaaguacugguaccugaaccacaccaccaccggcaagacgucccugcccaagugcuggcuggugagcaacggcuccuaccucaacgagacccacuucagcgacgacaucgagcagcaggccgacaacaugaucaccgagaugcugcagaaggaguacauggagcggcaggggaagacgccccugggccucgucgaccuguucguguucuccaccagcuucuaccugaucuccaucuuccugcaccucgugaagaucccgacccaccgccacaucgucggcaagagcugccccaagccccaccggcugaaccacauggggaucugcuccugcgggcuguacaagcagcccggcgugccggugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5429 - RNA, 1858 nt, Artificial Sequence
  mRNA product Design2 comprising derived and/or modified sequence from Lassa virus__AIT17348__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaacgacaccccgggcggguacugccugacccgguggaugcucaucgaggccgagcugaagugcuucggcaacaccgccguggccaagugcaacgagaagcacgacgaggaguucugcgacaugcugcgccucuucgacuucaacaagcaggccauccagcggcugaaggcggaggcccagaugagcauccagcugaucaacaaggccgucaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucguggaccuguucgucuucagcaccuccuucuaccugaucagcaucuuccugcaccucgugaagaucccgacccaccgccacaucguggggaagcccugccccaagccccaccggcugaaccacaugggcaucugcuccugcgggcuguacaagcagccgggcguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5430 - RNA, 1858 nt, Artificial Sequence
  mRNA product Design2 comprising derived and/or modified sequence from Lassa virus__AIT17350__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacaucauggugggcaacgagaccggccucgagcugacgcugaccaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgggggacgccgccaagcacugcggcacgguggccaacggggugcugcagaccuucaugcggauggcguggggcggcuccuacaucgcccucgacagcgggcgcaacggcugggacugcgucaugaccuccuaccaguaccugaucauccagaacaccacgugggaggaccacugccaguucagccggcccucccccaucggguaccugggccuccugagccagcgcacccgggacaucuacaucucccgccggcugcucggcaccuucaccuggacgcugagcgacagcgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggcgauccagcgccugaagacggaggcccagauguccauccagcugaucaacaaggccgugaacgcccucaucaacgaccagcugaucaugaagaaccaccuccgggacaucauggggauccccuacugcaacuacagcaaguacugguaccucaaccacaccgucaccggcaagaccucccugccccgcugcuggcuggugagcaacggcuccuaccucaacgagacgcacuucagcgacgacaucgagcagcaggccgacaacaugaucaccgagaugcugcagaaggaguacaucgagcggcaggggaagacgccccugggccucguggaccuguucgucuucuccaccagcuucuaccugaucuccaucuuccugcaccucgugaagaucccgacccaccgccacaucaucgggaagcccugccccaagccccaccggcugaaccacaugggcaucugcagcugcgggcuguacaagcagccgggcgugcccguccgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5431 - RNA, 1858 nt, Artificial Sequence
  mRNA product Design2 comprising derived and/or modified sequence from Lassa virus__AIT17354__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaucuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcacggcgggugggacugcaucaugaccagcuaccaguaccugaucauccagaacaccaccugggaggaccacugccaguucucccgccccagccccaucggcuaccugggccuccugucccagcggacgcgcgacaucuacaucagccggcgccugcucgggaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacaccacgaccggcaagaccagccugcccaagugcuggcugguguccaacgggagcuaccucaacgagacccacuucuccgacgacaucgagcagcaggccgacaacaugaucacggagaugcugcagaaggaguacauggagcggcagggcaagaccccgcuggggcucgucgaccuguucguguucagcaccuccuucuaccugaucagcaucuuccugcaccucgugaagaucccgacccaccgccacaucgucggcaagcccugcccccggccccaccgccugaaccacauggggaucugcuccugcggccuguacaagcagccgggcgugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5432 - RNA, 1858 nt, Artificial Sequence
  mRNA product Design2 comprising derived and/or modified sequence from Lassa virus__AIT17360__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucaaccaccgcuucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggcaagugggacugcaucaugaccagcuaccaguaccugaucauccagaacaccacgugggacgaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccggcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccugaaccacacgaccaccggcaagaccagccugccccgcugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcggguucuacaagcagcccggcgugccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5433 - RNA, 1858 nt, Artificial Sequence
  mRNA product Design2 comprising derived and/or modified sequence from Lassa virus__AIT17364__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacaucgagcggcagggcaagaccccgcuggggcucgucgaccuguucguguucagcaccuccuucuaccugaucagcaucuuccugcaccucgugaagaucccgacgcaccgccacaucgucggcaagcccugccccaagccccaccggcugaaccacauggggaucugcuccugcggccuguacaagcagccgggggugagcgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5434 - RNA, 1858 nt, Artificial Sequence
  mRNA product Design2 comprising derived and/or modified sequence from Lassa virus__AIT17368__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguucgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacagcaagugggacugcaucaugaccuccuaccaguaccugaucauccagaacaccacgugggacgaccacugccaguucagccgccccucccccaucggcuaccuggggcuccugagccagcggacccgcgacaucuacaucagccggcgccugcucggcaccuucaccuggacgcuguccgacagcgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagauguccauccagcugaucaacaaggccgugaacgcccucaucaacgaccagcugaucaugaagaaccaccuccgcgacaucaugggcauccccuacugcaacuacagcaaguacugguaccugaaccacacgaccaccgggaagaccucccugcccaagugcuggcuggugagcaacggcuccuaccucaacgagacgcacuucagcgacgacaucgagcagcaggccgacaacaugaucaccgagaugcugcagaaggaguacauggagcggcagggcaagaccccgcuggggcucgucgaccuguucguguucuccaccagcuucuaccugaucuccaucuuccugcaccucgugaagaucccgacgcaccgccacaucgucggcaagagcugccccaagccccaccggcugaacuacauggggaucugcuccugcggcuucuacaagcagcccggggugccggugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5435 - RNA, 1858 nt, Artificial Sequence
  mRNA product Design2 comprising derived and/or modified sequence from Lassa virus__AIT17370__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaagcccugccccaagccccaccggcugaaccacauggggaucugcuccugcggccuguacaagcagccgggggugagcgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5436 - RNA, 1858 nt, Artificial Sequence
  mRNA product Design2 comprising derived and/or modified sequence from Lassa virus__AIT17378__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccguccaguacaaccugagccacuccuacgccguggacgccgcgaaccacugcgggaccguggccaacggcguccuccagaccuucaugcggauggccuggggcgggagcuacaucgcccuggacuccggccgcagcgggugggacugcaucaugaccuccuaccaguaccuggugauccagaacacgaccugggaggaccacugccaguucagccggcccucccccaucggcuaccucgggcugcugagccagcgcacccgggacaucuacaucagccgccggcuccugggcaccuucacguggacccuguccgacagcgagggcaagaacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagauguccauccagcucaucaacaaggccgucaacgcccugaucaacgaccagcugaucaugaagaaccaccuccgggacaucaugggcauccccuacugcaacuacagcaaguacugguaccugaaccacaccaccaccgggcgcacgucccugccccggugcuggcucgugagcaacggcuccuaccugaacgagacccacuucagcgacgacaucgagcagcaggccgacaacaugaucaccgagaugcugcagaaggaguacauggagcgccagggcaagaccccgcucgggcugguggaccuguucgucuucuccacgagcuucuaccugaucuccaucuuccuccaccuggugaagaucccgacccaccggcacaucgugggcaagagcugccccaagccccaccgccugaaccacauggggaucugcuccugcggcuucuacaagcagcccggggucccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5437 - RNA, 1858 nt, Artificial Sequence
  mRNA product Design2 comprising derived and/or modified sequence from Lassa virus__AIT17388__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaucaucagcguccaguacaaccugucccacagcuacgcgggggacgccgccaaccacugcggcacgguggccaacggggugcugcagaccuucaugcgcauggcguggggcggcuccuacaucgcccucgacagcgggcggaacggcugggacugcaucaugaccuccuaccaguaccugaucauccagaacaccacgugggacgaccacugccaguucagccgccccucccccaucggguaccugggccuccugagccagcggacccgcgacaucuacaucucccggcgccugcucggcaccuucaccuggacgcugagcgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggcgauccagcggcugaagacggaggcccagaugaacauccagcugaucaacaaggccgugaacgcccucaucaacgaccagcugaucaugaagaaccaccuccgcgacaucauggggauccccuacugcaacuacuccaaguacugguaccugaacaacaccgccaccggcaagaccagccugccccggugcuggcugguguccaacggcagcuaccucaacgagacgcacuucuccgacgacaucgagcagcaggcggacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugccccaagccccaccgccugaaccacaucggcaucugcuccugcgggcuguacaagcagccgggcgugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5438 - RNA, 1855 nt, Artificial Sequence
  mRNA product Design2 comprising derived and/or modified sequence from Lassa virus__AIT17404__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucaucaagaucccgacccaccgccacaucaccggcaagcccugccccaagccccaccggcugaaccacauggggaucugcuccugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5439 - RNA, 1855 nt, Artificial Sequence
  mRNA product Design2 comprising derived and/or modified sequence from Lassa virus__AIT17408__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccgucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5440 - RNA, 1855 nt, Artificial Sequence
  mRNA product Design2 comprising derived and/or modified sequence from Lassa virus__AIT17412__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccuccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggcgaagugcaacgagaagcacgacgaggaguucugcgacaugcugcgccuguucgacuucaacaagcaggccauccggcgccucaagaccgaggcccagauguccauccagcugaucaacaaggccgugaacgcccugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggcggacaacaugaucaccgagcuccugcagaaggaguacaucgaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5441 - RNA, 1855 nt, Artificial Sequence
  mRNA product Design2 comprising derived and/or modified sequence from Lassa virus__AIT17416__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcgcauggccuggggcggguccuacaucgcccuggacagcggcaagggguccugggacugcaucaugacgagcuaccaguaccucaucauccagaacaccuccugggaggaccacugccaguucagccggcccagccccaucggcuaccuggggcugcucucccagcgcacccgggacaucuacaucagccgccggcugcugggcaccuucacguggacccucuccgacagcgagggcaacgagacccccgggggcuacugccugacccgcuggaugcugaucgaggccgagcucaagugcuucgggaacacggccguggcgaagugcaacgagaagcacgacgaggaguucugcgacaugcugcggcuguucgacuucaacaagcaggccauccgccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacaccgucaccgggaagacgucccugccccggugcuggcuggugagcaacggcuccuaccugaacgagacccacuucagcgacgacaucgagcagcaggcggacaacaugaucaccgagcuccugcagaaggaguacaucgaccgccagggcaagaccccgcuggggcucguggaccuguucgucuucuccacgagcuucuaccugaucuccaucuuccugcaccucgugaagaucccgacccaccggcacgugaucggcaagcccugccccaagccccaccgccugaaccacauggggaucugcagcugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5442 - RNA, 1855 nt, Artificial Sequence
  mRNA product Design2 comprising derived and/or modified sequence from Lassa virus__AIT17420__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucaucaagaucccgacccaccgccacaucacgggcaagcccugccccaagccccaccggcugaaccacauggggaucugcuccugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5443 - RNA, 1855 nt, Artificial Sequence
  mRNA product Design2 comprising derived and/or modified sequence from Lassa virus__AIT17424__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacaaccacgcccugaugagcaucaucuccaccuuccaccugagcauccccaacuucaaccaguacgaggccauguccugcgacuucaacgggggcaagaucagcgugcaguacaaccucucccacgccuacgcgguggacgccgccaaccacugcgggaccaucgccaacggcguccugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagacgaacauccagcugaucaacaaggccgugaacgcccugaucaacgaccagcucaucaugaagaaccaccuccgggacaucaugggcauccccuacugcaacuacuccaaguacugguaccugaaccacaccgucaccgggaagaccagccugccccgcugcuggcugguguccaacggcagcuaccugaacgagacgcacuucuccgacgacaucgagcagcaggccgacaacaugaucaccgagcuccugcagaaggaguacauggaccggcagggcaagaccccgcuggggcucguggaccuguucgucuucagcaccuccuucuaccugaucagcaucuuccugcaccucgugaagaucccgacgcaccgccacaucaucggcaagcccugccccaagccccaccggcugaaccacauggggaucugcuccugcggccuguacaagcacccgggggugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5444 - RNA, 1855 nt, Artificial Sequence
  mRNA product Design2 comprising derived and/or modified sequence from Lassa virus__AIT17428__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgccgccgaccucaagugcuucgggaacaccgccguggcgaagugcaacgagaagcacgacgaggaguucugcgacaugcugcgccuguucgacuucaacaagcaggccaucgagcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggcggaccagccugccccgcugcuggcugguguccaacggcagcuaccugaacgagacccacuucuccgacgacaucgagcagcaggcggacaacaugaucacggagcuccugcagaaggaguacauggaccggcagggcaagaccccgcuggggcucguggaccuguucgucuucagcaccuccuucuaccugaucagcaucuuccugcaccucgugcgcaucccgacccaccggcacgugaucggcaagcccugccccaagccccaccgccugaaccacauggggaucugcuccugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5445 - RNA, 1855 nt, Artificial Sequence
  mRNA product Design2 comprising derived and/or modified sequence from Lassa virus__AIT17430__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggccggaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5446 - RNA, 1855 nt, Artificial Sequence
  mRNA product Design2 comprising derived and/or modified sequence from Lassa virus__AIT17438__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacauccgggucggcaacgagaccggccuggagcucacccugaccaacacgagcaucaucucccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaaggagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugaacauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggccgacaacaugaucacggagcuccugcagaaggaguacaucgaccgccagggcaagaccccgcuggggcucguggaccuguucgucuucuccaccagcuucuaccugaucuccaucuuccugcaccucgugaagaucccgacccaccggcacgugaucggcaagcccugccccaagccccaccgccugaaccagauggggaucugcagcugcggccuguacaagcagccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5447 - RNA, 1855 nt, Artificial Sequence
  mRNA product Design2 comprising derived and/or modified sequence from Lassa virus__AIT17442__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcgcauggccuggggcggguccuacaucgcccuggacagcggcaagggguccugggacugcaucaugacgagcuaccaguaccucaucauccagaacaccuccugggaggaccacugccaguucagccggcccagccccaucggcuaccuggggcugcucucccagcgcacccgggacaucuacaucagccgccggcugcugggcaccuucacguggacccucuccgacagcgagggcaacgagacccccgggggcuacugccugacccgcuggaugcugaucgaggccgagcucaagugcuucgggaacacggccguggcgaagugcaacgagaagcacgacgaggaguucugcgacaugcugcggcuguucgacuucaacaagcaggccauccgccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacaccgucaccgggaagacgucccugccccggugcuggcuggugagcaacggcuccuaccugaacgagacccacuucagcgacgacaucgagcagcaggcggacaacaugaucaccgagcuccugcagaaggaguacaucgaccgccagggcaagaccccgcuggggcucguggaccuguucgucuucuccacgagcuucuaccugaucuccaucuuccugcaccucgugaagaucccgacccaccggcacgugaucggcaagcccugccccaagccccaccgcaucaaccacauggggaucugcagcugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5448 - RNA, 1855 nt, Artificial Sequence
  mRNA product Design2 comprising derived and/or modified sequence from Lassa virus__AIT17446__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccucccacugcgggaccgucgccaacggcgugcugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccagccccaucggcuaccuggggcugcucucccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugccccgcugcuggcuggugagcaacggcuccuaccugaacgagacccacuucagcgacgacaucgagcagcaggccgacaacaugaucacggagcuccugcagaaggaguacauggaccggcagggcaagaccccgcuggggcucgucgaccuguucguguucuccaccagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5449 - RNA, 1855 nt, Artificial Sequence
  mRNA product Design2 comprising derived and/or modified sequence from Lassa virus__AIT17450__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacaucaucggcaagcccugccccaagccccaccggcugaaccacauggggaucugcuccugcggccuguacaagcacccgggggugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5450 - RNA, 1855 nt, Artificial Sequence
  mRNA product Design2 comprising derived and/or modified sequence from Lassa virus__AIT17454__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgccuucagccuccuggccauccugaaggggaucuacaacgucgcgaccugcggccucuucgggcugguguccuuccugcuccugugcggccgcagcugcuccaccaccuacaaggggguguacgagcugcagacccucgagcuggacauggccagccugaacaugaccaugccgcucuccugcacgaagaacaacagccaccacuacaucauggucggcaacgagaccggccuggagcugacccucaccaacacguccaucaucaaccacaaguucugcaaccugagcgacgcccacaagcggaaccuguacgaccacgcccucauguccaucaucagcaccuuccaccuguccauccccaacuucaaccaguacgaggccaugagcugcgacuucaacgggggcaagaucuccgugcaguacaaccugagccacaccuacgcgguggacgccgccgggcacugcggcaccaucgccaacgggguccuccagacguucaugcgcauggcguggggcggcuccuacaucgcccuggacagcgggaagggcuccugggacugcaucaugaccagcuaccaguaccugaucauccagaacaccaccugggaggaccacugccaguucucccggcccagccccaucggguaccucggccugcugagccagcgcacgcgggacaucuacaucucccgccggcuccugggcaccuucaccuggacccugagcgacuccgaggggaacgagacgccgggcggguacugccucacccgcuggaugcugaucgaggccgagcugaagugcuucggcaacaccgccguggccaagugcaacgagaagcacgacgaggaguucugcgacaugcuccggcuguucgacuucaacaagcaggcgauccgccggcugaagaccgaggcccagaugagcauccagcucaucaacaaggccgugaacgcccugaucaacgaccagcugaucaugaagaaccaccuccgcgacaucauggggauccccuacugcaacuacuccaaguacugguaccugaaccacacgaucaccggcaagaccagccugccccggugcuggcucgucuccaacggcagcuaccugaacgagacccacuucuccgacgacaucgagcagcaggccgacaacaugaucacggagcugcuccagaaggaguacauggaccgccaggggaagacgccccugggccugguggaccucuucguguucagcaccuccuucuaccugaucagcaucuuccugcaccuggucaagaucccgacccaccggcacaucaucgggaagcccugccccaagccccaccgccucaaccacaugggcaucugcuccugcgggcuguacaagcacccgggcgugcccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5451 - RNA, 1855 nt, Artificial Sequence
  mRNA product Design2 comprising derived and/or modified sequence from Lassa virus__AIT17458__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggcaagggguccugggacugcaucaugaccaccuaccaguaccucaucauccagaacaccacgugggaggaccacugccaguucagccgccccucccccaucggcuaccuggggcugcucagccagcggacccgcgacaucuacaucagccggcgccugcugggcaccuucaccuggacgcucuccgacagcgagggcaacgagacccccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagacggaggcccagauguccauccagcugaucaacaaggccgugaacgcccugaucaacgaccagcucaucaugaagaaccaccuccgggacaucaugggcauccccuacugcaacuacagcaaguacugguaccugaaccacaccgugaccgggaagaccucccugccccgcugcuggcuggucagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucguguucuccaccagcuucuaccugaucuccaucuuccugcaccucgucaagaucccgacgcaccgccacgugaucggcaagcccugccccaagccccaccggcugaaccacauggggaucugcagcugcggccuguacaagcacccgggggugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5452 - RNA, 1855 nt, Artificial Sequence
  mRNA product Design2 comprising derived and/or modified sequence from Lassa virus__AIT17462__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugcccaagugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5453 - RNA, 1855 nt, Artificial Sequence
  mRNA product Design2 comprising derived and/or modified sequence from Lassa virus__AIT17466__GPC (opt1)
ggggcgcugccuacggagguggcagccaucuccuucucggcaucaagcuuaccaugggccagaucaucaccuucuuccaggaggugccccaggucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaaccaguccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuucgcgguggacgccgccaaccacugcgggaccaucgccaacggcguccugcagaccuucaugcggauggcguggggcggguccuacaucgcccuggacagcggccgcggguccugggacugcaucaugacgagcuaccaguaccucaucauccagaacaccaccugggaggaccacugccaguucucccggcccagccccaucggcuaccuggggcugcucagccagcgcacccgggacaucuacaucucccgccggcugcugggcacguucaccuggacccucagcgacuccgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccaucacggggaagaccagccugccccggugcuggcuggucuccaacggcagcuaccugaacgagacccacuucuccgacgacaucgagcagcaggccgacaacaugaucaccgagcuccugcagaaggaguacauggaccgccagggcaagacgccccuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5454 - RNA, 1855 nt, Artificial Sequence
  mRNA product Design2 comprising derived and/or modified sequence from Lassa virus__AIT17470__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5455 - RNA, 1855 nt, Artificial Sequence
  mRNA product Design2 comprising derived and/or modified sequence from Lassa virus__AIT17474__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccauccaguacaaccucagccacaccuacgcgguggacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacgaucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacaucacgggcaagcccugccccaagccccaccggcugaaccacauggggaucugcuccugcggccuguacaagcacccggggguccccgugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5456 - RNA, 1855 nt, Artificial Sequence
  mRNA product Design2 comprising derived and/or modified sequence from Lassa virus__AIT17478__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccgaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucagccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggccgacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacgugaucggcaagcccugccccaagccccaccgccucaaccacauggggaucugcagcugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5457 - RNA, 1855 nt, Artificial Sequence
  mRNA product Design2 comprising derived and/or modified sequence from Lassa virus__AIT17482__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaucaccugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggccgagcucaagugcuucgggaacacggccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgucaccgggaagacgagccugccccgcugcuggcugguguccaacggcagcuaccugaacgagacccacuucuccgacgacaucgagcagcaggcggacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacguggucggcaagcccugccccaagccccaccggcugaaccacauggggaucugcuccugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5458 - RNA, 1855 nt, Artificial Sequence
  mRNA product Design2 comprising derived and/or modified sequence from Lassa virus__AIT17486__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccgugggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5459 - RNA, 1855 nt, Artificial Sequence
  mRNA product Design2 comprising derived and/or modified sequence from Lassa virus__AIT17490__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucacccucagccugcuggccauccucaaggggaucuacaacgucgccacgugcggccuguucgggcugguguccuuccuccugcugugcggccgcagcugcuccaccaccuacaaggggguguacgagcuccagacccuggagcuggacauggcgaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuucgccguggacgcggccaaccacugcgggacgaucgccaacggcguccugcagaccuucaugcggauggccuggggcgggagcuacaucgcgcuggacuccggcaaggggagcugggacugcaucaugaccuccuaccaguaccucaucauccagaacaccacgugggaggaccacugccaguucagccgccccucccccaucggcuaccuggggcugcucagccagcggacccgcgacaucuacaucagccggcgccugcugggcaccuucaccuggacgcucuccgacagcgagggcaacgagacccccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagacggaggcgcagauguccauccagcugaucaacaaggccgugaacgcccugaucaacgaccagcucaucaugaagaaccaccuccgggacaucaugggcauccccuacugcaacuacagcaaguacugguaccugaaccacaccgucaccgggaagaccucccugccccgcugcuggcuggugagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucgucuucuccaccagcuucuaccugaucuccaucuuccugcaccucgugaagaucccgacgcaccgccacaucaucggcaagcccugccccaagccccaccggcugaaccacauggggaucugcagcugcggccuguacaagcacccgggggugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5460 - RNA, 1855 nt, Artificial Sequence
  mRNA product Design2 comprising derived and/or modified sequence from Lassa virus__AIT17494__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaucuacaagggggucuacgagcuccagacccuggagcuggacauggccagccucaacaugaccaugccgcuguccugcaccaagaacaacagccaccacuacaucauggugggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagaccuucaugcggauggcguggggcggguccuacaucgcccuggacagcggcaagggguccugggacugcaucaugacgagcuaccaguaccucaucauccagaacaccuccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacaccgugaccgggaagacgucccugccccgcugcuggcuggugagcaacggcuccuaccugaacgagacccacuucagcgacgacaucgagcagcaggccgacaacaugaucaccgagcuccugcagaaggaguacaucgaccggcagggcaagaccccgcuggggcucgucgaccuguucguguucuccacgagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5461 - RNA, 1855 nt, Artificial Sequence
  mRNA product Design2 comprising derived and/or modified sequence from Lassa virus__AIT17498__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgagaccgagcucaagugcuucgggaacaccgccguggccaagugcaacgagaagcacgacgaggaguucugcgacaugcugcgccuguucgacuucaacaagcaggccaucucccggcuccgcagcgaggcgcagauguccauccagcugaucaacaaggccgugaacgcccugaucaacgaccagcucaucaugaagaaccaccuccgggacaucaugggcauccccuacugcaacuacagcaaguacugguaccugaaccacacggucaccgggaagaccucccugcccaagugcuggcuggugagcaacggcuccuaccugaacgagacccacuucagcgacgacaucgagcagcaggccgacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacaucacgggcaagcccugccccaagccccaccgccucaaccacauggggaucugcagcugcggccuguacaagcacccgggggugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5462 - RNA, 1855 nt, Artificial Sequence
  mRNA product Design2 comprising derived and/or modified sequence from Lassa virus__AIT17502__GPC (opt1)
ggggcgcugccuacggagguggcagccaucuccuucucggcaucaagcuuaccaugggccagaucaucaccuucuuccaggagaucccccacgugaucgaggaggucaugaacaucgugcugaucacccucagccugcuggccauccucaaggggaucuacaacguggccacgugcggccuguucgggcuggucuccuuccuccugcugugcggcaagagcugcuccaccaccuacaaggggguguacgagcuccagacccuggagcuggacauggcgagccucaacaugacgaugccgcuguccugcaccaagaacaacagccaccacuacaucauggugggcaacgagaccggccuggagcucacccugacgaacaccuccaucaucaaccacaaguucugcaaccugagcgacgcccaccgcaagaaccucuacgaccacacccugauguccaucaucagcaccuuccaccuguccauccccaacuucaaccaguacgaggccaugagcugcgacuucaacgggggcaagaucuccguccaguacaaccucagccacgccuacgccaucgacgcggccacgcacugcgggaccaucgccaacggcgugcugcagaccuucaugcggauggccuggggcggguccuacaucgcgcuggacagcggcaagggcgggugggacugcaucaugaccuccuaccaguaccucaucauccagaacacgaccugggaggaccacugccaguucagccgccccucccccaucggguaccugggccugcucagccagcggacccgcgacaucuacaucagccggcgccugcugggcaccuucacguggacccucuccgacagcgaggggaacgagaccccgggcggguacugccugacccgguggaugcugaucgaggccgagcucaagugcuucggcaacacggccguggccaagugcaacgagaagcacgacgaggaguucugcgacaugcugcgccuguucgacuucaacaagcaggccauccggcgccucaagaccgaggcgcagauguccauccagcugaucaacaaggccgucaacgcccugaucaacgaccagcucaucaugcggaaccaccuccgcgacaucauggggauccccuacugcaacuacagcaaguacugguaccugaaccacaccgugaccggcaagacgucccugcccaagugcuggcuggugagcaacggcuccuaccugaacgagacccacuucagcgacgacaucgagcagcaggccgacaacaugaucaccgagcuccugcagaaggaguacauggaccggcaggggaagacgccccugggccucgucgaccuguucguguucuccaccagcuucuaccugaucuccaucuuccugcaccucgugaagaucccgacccaccgccacgucaucgggaagcccugccccaagccccaccggcugaaccacaugggcgugugcagcugcgggcuguacaagcacccgggcgugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5463 - RNA, 1855 nt, Artificial Sequence
  mRNA product Design2 comprising derived and/or modified sequence from Lassa virus__AIT17506__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccgagcacugcgggaccaucgcgaacggcguccugcagaccuucaugcggauggccuggggcggguccuacaucgcccuggacagcggcaagggguccugggacugcgugaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccaucgagcggcucaagaccgaggcccagaugagcauccagcugaucaacaaggccgucaacgcccugaucaacgaccagcucaucaugaagaaccaccuccgcgacaucaugggcaucccguacugcaacuacuccaaguacugguaccugaaccacaccgugacggggaagaccagccugccccggugcuggcugguguccaacggcagcuaccugaacgagacccacuucuccgacgacaucgagcagcaggcggacaacaugaucaccgagaugcuccagaaggaguacaucgaccgccagggcaagacgccccuggggcuggucgaccucuucguguucagcaccuccuucuaccugaucagcaucuuccugcaccuggugaagaucccgacccaccggcacgucaucggcaagcccugccccaagccccaccgccucaaccacauggggaucugcuccugcggccuguacaagcacccgggggugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5464 - RNA, 1855 nt, Artificial Sequence
  mRNA product Design2 comprising derived and/or modified sequence from Lassa virus__AIT17510__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgaaggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5465 - RNA, 1855 nt, Artificial Sequence
  mRNA product Design2 comprising derived and/or modified sequence from Lassa virus__AIT17514__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccguccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguaccgccacccgggggugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5466 - RNA, 1855 nt, Artificial Sequence
  mRNA product Design2 comprising derived and/or modified sequence from Lassa virus__AIT17518__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5467 - RNA, 1855 nt, Artificial Sequence
  mRNA product Design2 comprising derived and/or modified sequence from Lassa virus__AIT17524__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggugaccgggaagaccagccugccccgcugcuggcuggucuccaacggcagcuaccugaacgagacccacuucuccgacgacaucgagcagcaggccgacaacaugaucacggagaugcuccagaaggaguacauggaccggcagggcaagaccccgcuggggcugguggaccucuucguguucagcaccuccuucuaccugaucagcaucuuccugcaccuggucaagaucccgacccaccgccacgugaucggcaagcccugccccaagccccaccggcucaaccacauggggaucugcuccugcggccuguacaagcacccgggggugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5468 - RNA, 1855 nt, Artificial Sequence
  mRNA product Design2 comprising derived and/or modified sequence from Lassa virus__AIT17528__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccaugcucaaggggaucuacaacaucgcgaccugcggccuguucgggcugaucuccuuccuccugcugugcggccgcagcugcuccacgaccuacaagggggucuacgagcuccaggcccuggagcuggacauggccaaccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggcgauguccugcgacuucaacgggggcaagaucagcgugcaguacaaccucucccacaccuacgccggggacgccgccaagcacugcggcaccaucgcgaacgggguccugcagaccuucaugcggauggccuggggcggcagcuacaucgcccuggacuccgggaagggcaacugggacugcaucaugacgagcuaccaguaccucaucauccagaacaccaccugggaggaccacugccaguucucccgccccagccccaucggguaccugggccugcucucccagcggacccgcgacaucuacaucagccggcgccugcugggcacguucaccuggacccucagcgacuccgaggggaacgagaccccgggcggguacugccugacgcgguggaugcugaucgaggccgagcucaagugcuucggcaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucauggggauccccuacugcaacuacuccaaguacugguaccugaaccacagcgucaccggccgcacgucccugccccggugcuggcuggugagcaacggcuccuaccugaacgagacccaguucagcgacgacaucgagcagcaggcggacaacaugaucaccgagaugcuccagaaggaguacaucgaccgccaggggaagacgccccugggccugguggaccucuucgucuucuccaccagcuucuaccugaucuccaucuuccugcaccugaucaagaucccgacccaccggcacaucguggggaagcccugccccaagccccaccgccucaaccacaugggcaucugcagcugcgggcuguacaagcacccgggcauccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5469 - RNA, 1855 nt, Artificial Sequence
  mRNA product Design2 comprising derived and/or modified sequence from Lassa virus__AIT17538__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacaucgcgaccugcggccuguucgggcugaucuccuuccuccugcugugcggccgcagcugcuccacgaccuacaagggggucuacgagcuccagacccuggagcuggacauggccaaccucaacaugaccaugccgcugagcugcacgaagaacaacucccaccacuacaucauggugggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgaggggaagaucagcgugcaguacaaccucucccacagcuacgcgaucgacgccgccggccacugcgggaccaucgccaacggcguccugcagaccuucaugcggauggcguggggcggguccuacaucgcccuggacagcggcaaggggaacugggacugcaucaugacguccuaccaguaccucaucauccagaacaccaccugggaggaccacugccaguucagccgccccucccccaucggcuaccuggggcugcucagccagcggacccgcgacaucuacaucagccggcgccugcugggcacguucaccuggacccucuccgacagcgagggcaacgaggcccccgggggcuacugccugacccgguggaugcugaucgaggccgagcucaagugcuucgggaacacggccaucgcgaagugcaacgagaagcacgacgaggaguucugcgacaugcugcgccuguucgacuucaacaagcaggccaucaagcggcucaaggccgaggcccagauguccauccaccugaucaacaaggccgugaacgcgcugaucaacgaccagcucaucaugaagaaccaccuccgcgacaucaugggcauccccuacugcaacuacagcaaguacugguaccugaaccacaccgugaccgggaagaccucccugcccaagugcuggcuggucagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucguguucuccaccagcuucuaccugaucuccaucuuccugcaccucgucaagaucccgacgcaccgccacaucgugggccggcccugccccaagccccaccgccugaaccacauggggaucugcagcugcggccuguacaagcacccgggggugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5470 - RNA, 1855 nt, Artificial Sequence
  mRNA product Design2 comprising derived and/or modified sequence from Lassa virus__AIT17540__GPC (opt1)
ggggcgcugccuacggagguggcagccaucuccuucucggcaucaagcuuaccaugggccagaucgugaccuucuuccaggaggucccccacgugaucgaggagaucaugaacaucgugcugaucacccucagccugcuggccauccucaaggggaucuacaacuucgccacgugcggccugaucgggcugaucaccuuccucuuccugugcggccgcuccugcagcaccaucuacaagggguccuaccagcugcagacccucgagcugaacauggagacgcugaacaugaccaugccgcucagcugcaccaagaacaacucccaccacuacauccgggucggcaacgagaccggccuggagcugacgcucaccaacaccagcaucaucaaccacaaguucugcaaccuguccgaggcgcacaagaagaaccuguacgaccacgcccucaugagcaucaucuccaccuuccaccugagcauccccaacuucaaccaguacgaggccauguccugcgacuucaacgggggcaagaucagcgugcaguacaaccugucccacagcuacgccguggacgccgcgaaccacugcgggacggucgccaacggcgugcuccagaccuucaugcgcauggccuggggcggguccuacaucgcccuggacagcggccgggggaacugggacugcaucaugaccuccuaccaguaccugaucauccagaacaccacgugggaggaccacugccaguucagccgccccucccccaucggcuaccucgggcugcugagccagcggacccgcgacaucuacaucagccggcgccuccugggcaccuucaccuggacgcuguccgacagcgagggcaaggagacccccgggggcuacugccucacccgguggaugcugaucgaggcggagcugaagugcuucgggaacaccgccguggccaagugcaacgagaagcacgacgaggaguucugcgacaugcuccgccuguucgacuucaacaagcaggccauccagcggcugaagacggaggcccagauguccauccagcucaucaacaaggcggucaacgcccugaucaacgaccagcugaucaugaagaaccaccuccgcgacaucaugggcauccccuacugcaacuacagcaaguacugguaccugaaccacaccuccaccgggcggaccagccugcccaagugcuggcucguguccaacggcagcuaccugaacgagacgcacuucuccgacgacaucgagcagcaggccgacaacaugaucaccgagaugcugcagaaggaguacaucgaccgccagggcaagaccccgcucgggcugguggaccuguucgucuucagcaccuccuucuaccucaucagcaucuuccugcaccuggugaagaucccgacgcaccggcacaucgugggcaaguccugccccaagccccaccgccugaaccacauggggaucugcagcugcggccucuacaagcagcccggggucccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5471 - RNA, 1855 nt, Artificial Sequence
  mRNA product Design2 comprising derived and/or modified sequence from Lassa virus__AIT17544__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugggcagccucaacaugaccaugccgcuguccugcacgaagaacaacagccaccacuacaucauggucggcaacgagaccgggcuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacggcgggaagaucuccgugcaguacaaccucagccacuccuacgccguggacgcggccaaccacugcggcaccaucgccaacgggguccugcagaccuucaugcggauggccuggggcggcagcuacaucgcgcuggacuccgggaagggcagcugggacugcaucaugacguccuaccaguaccucaucauccagaacaccaccugggaggaccacugccaguucagccgccccagccccaucggguaccugggccugcucucccagcggacccgcgacaucuacaucagccggcgccugcugggcacguucaccuggacccucuccgacagcgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggccauccggcgccucaagaccgaggcgcagauguccauccagcugaucaacaaggccgugaacgcccugaucaacgaccagcucaucaugaagaaccaccuccgggacaucauggggauccccuacugcaacuacagcaaguacugguaccugaaccacaccgucacgggcaagaccucccugccccgcugcuggcuggugagcaacggcuccuaccugaacgagacccacuucagcgacgacaucgagcagcaggccgacaacaugaucaccgagcuccugcagaaggaguacauggaccggcaggggaagacgccccugggccucguggaccuguucgucuucuccaccagcuucuaccugaucuccaucuuccugcaccucgugaagaucccgacccaccgccacaucaucgggaagcccugccccaagccccaccggcugaaccacaugggcaucugcagcugcgggcuguacaagcacccgggcgugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5472 - RNA, 1855 nt, Artificial Sequence
  mRNA product Design2 comprising derived and/or modified sequence from Lassa virus__AIT17548__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccucuuccugugcggccgcagcugcuccacgaccuacaaggggguguacgagcugcagacccucgagcuggacauggccagccugaacaugaccaugccgcucuccugcacgaagaacaacagccaccacuacaucauggucggcaacgagaccggccuggagcugacccucaccaacacguccaucaucaaccacaaguucugcaaccugagcgacgcccacaagcggaaccuguacgaccacgcccucauguccaucaucagcaccuuccaccuguccauccccaacuucaaccaguacgaggccaugagcugcgacuucaacgggggcaagaucuccgugcaguacaaccugagccacgcguacgccggggacgccgccaagcacugcggcaccaucgcgaacggggugcuccagaccuucaugcgcauggccuggggcggcuccuacaucgcccuggacagcgggaagggcuccugggacugcaucaugacgagcuaccaguaccugaucauccagaacaccaccugggaggaccacugccaguucucccggcccagccccaucggguaccucggccugcugagccagcgcacccgggacaucuacaucucccgccggcuccugggcacguucaccuggacccugagcgacuccgaggggaacgagaccccgggcggguacugccucacgcgcuggaugcugaucgaggccgagcugaagugcuucggcaacaccgccgucgcgaagugcaacgagaagcacgacgaggaguucugcgacaugcuccggcuguucgacuucaacaagcaggccauccgccggcugcgcaccgaggcccagaugagcauccagcucaucaacaaggccgugaacgcccugaucaacgaccagcugaucaugaagaaccaccuccgggacaucauggggauccccuacugcaacuacuccaaguacugguaccugaaccacaccgugacgggcaagaccagccugcccaagugcuggcucgucuccaacggcagcuaccugaacgagacccacuucuccgacgacaucgagcagcaggcggacaacaugaucaccgagaugcugcagaaggaguacaucgaccgccaggggaagacgccccucggccugguggaccuguucguguucagcaccuccuucuaccucaucagcaucuuccugcaccuggucaagaucccgacccaccggcacgugaucgggaagcccugccccaagccccaccgccugaaccacaugggcaucugcuccugcgggcucuacaagcacccgggcgugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5473 - RNA, 1855 nt, Artificial Sequence
  mRNA product Design2 comprising derived and/or modified sequence from Lassa virus__AIT17552__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccgugaacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5474 - RNA, 1855 nt, Artificial Sequence
  mRNA product Design2 comprising derived and/or modified sequence from Lassa virus__AIT17556__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggccgcggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacgaucaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacaucacgggcaagcccugccccaagccccaccgccugaaccacauggggaucugcuccugcggccuguacaagcacccgggggugcccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5475 - RNA, 1855 nt, Artificial Sequence
  mRNA product Design2 comprising derived and/or modified sequence from Lassa virus__AIT17560__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccguccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaccaacaacagccaccacuacaucauggugggcaacgagaccggccuggagcucacccugacgaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccggggaggccgccaaccacugcggcaccaucgcgaacgggguccugcagacguucaugcggauggccuggggcggcuccuacaucgcccuggacagcgggaagggcuccugggacugcaucaugaccagcuacaaguaccucaucauccagaacaccaccuggggcgaccacugccaguucucccgccccagccccaucggguaccugggccugcucagccagcggacgcgcgacaucuacaucucccggcgccugcuggggaccuucaccuggacccucagcgacuccgagggcaacgagacgcccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccauccggaagcucaagaccgaggcccagaugagcauccagcugaucaacaaggccgugaacgcccugaucaacgaccagcucaucaugaagaaccaccuccgcgacaucaugggcauccccuacugcaacuacucccgguacugguaccugaaccacacggucaccggccgcaccagccugccccggugcuggcugguguccaacgggagcuaccugaacgagacccacuucuccgacgacaucgagcagcaggcggacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggcgugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5476 - RNA, 1855 nt, Artificial Sequence
  mRNA product Design2 comprising derived and/or modified sequence from Lassa virus__AIT17564__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugcucuccuuccugcugcucugcggccgcagcugcuccacgaccuacaaggggguguacgagcugcagacccuggagcucgacauggccagccugaacaugaccaugccgcuguccugcacgaagaacaacagccaccacuacaucauggugggcaacgagaccggccucgagcugacccugaccaacacguccaucaucaaccacaaguucugcaaccucagcgacgcccacaagaaggaccuguacgaccacgcccugauguccaucaucagcaccuuccaccucuccauccccaacuucaaccaguacgaggccaugagcugcgacuucaacgggggcaagaucuccguccaguacaaccugagccacgcguacgccguggacgccgccaagcacugcgggaccaucgcgaacggcgugcugcagaccuucaugcggauggccuggggcggguccuacaucgcccucgacagcggcaagggguccugggacugcaucaugacgagcuaccaguaccugaucauccagaacaccuccugggaggaccacugccaguucagccgccccagccccaucggcuaccuggggcuccugucccagcggacccgcgacaucuacaucagccggcgccugcucggcaccuucacguggacccuguccgacagcgagggcaacgagacccccgggggcuacugccugacccgguggaugcucaucgaggccgagcugaagugcuucgggaacacggccgucgcgaagugcaacgagaagcacgacgaggaguucugcgacaugcugcgccucuucgacuucaacaagcaggccaucaagcggcugaagaccgaggcccagauguccauccagcugaucaacaaggccgugaacgcccucaucaacgaccagcugaucaugaagaaccaccuccgcgacaucaugggcauccccuacugcaacuacagcaaguacugguaccugaaccacaccgugaccgggaagacgucccugccccggugcuggcuggucagcaacggcuccuaccucaacgagacccacuucagcgacgacaucgagcagcaggcggacaacaugaucaccgagcugcugcagaaggaguacaucgaccgccagggcaagaccccgcucgggcugguggaccuguucguguucuccacgagcuucuaccugaucuccaucuuccuccaccuggucaagaucccgacccaccggcacgugaucggcaagcccugccccaagccccaccgccugaaccacauggggaucugcagcugcggccucuacaagcacccgggggugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5477 - RNA, 1855 nt, Artificial Sequence
  mRNA product Design2 comprising derived and/or modified sequence from Lassa virus__AIT17572__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaacuacgcgguggacgccgccaaccacugcgggaccaucgccaacggcguccugcagaccuucaugcggauggcguggggcgggagcuacaucgcccuggacuccggcaaggggaacugggacugcaucaugacgagcuaccaguaccucaucauccagaacaccaccugggaggaccacugccaguucucccgccccagccccaucggcuaccuggggcugcucucccagcggacccgcgacaucuacaucagccggcgccugcugggcacguucaccuggacccucagcgacuccgagggcaacgacaugcccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagaugaacauccagcugaucaacaaggccgugaacgcccugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacaucaucggcaagcccugccccaagccccaccggcugaaccacauggggaucugcagcugcggccuguacaagcacccgggggugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5478 - RNA, 1855 nt, Artificial Sequence
  mRNA product Design2 comprising derived and/or modified sequence from Lassa virus__AIT17576__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucucccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagaugcuccagaaggaguacaucgaccgccagggcaagaccccgcuggggcugguggaccucuucgucuucagcaccuccuucuaccugaucagcaucuuccugcaccuggugaagaucccgacccaccggcacaucacgggcaagcccugccccaagccccaccgccucaaccacauggggaucugcuccugcggccuguacaagcacccgggggugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5479 - RNA, 1855 nt, Artificial Sequence
  mRNA product Design2 comprising derived and/or modified sequence from Lassa virus__AIT17580__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagagcaacgagacgccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggcgauccggcgccucaaggccgaggcccagauguccauccagcugaucaacaaggccgugaacgcccugaucaacgaccagcucaucaugaagaaccaccuccgggacaucauggggauccccuacugcaacuacagcaaguacugguaccugaaccacaccgucacgggccgcaccucccugccccggugcuggcuggugagcaacggguccuaccugaacgagacccacuucagcgacgacaucgagcagcaggcggacaacaugaucaccgagcuccugcagaaggaguacauggaccgccagggcaagacgccccugggccucguggaccuguucgucuucuccaccagcuucuaccugaucuccaucuuccugcaccucgugaagaucccgacccaccggcacgugaucgggaagcccugccccaagccccaccgccugaaccacaugggcaucugcagcugcgggcuguacaagcacccgggcguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5480 - RNA, 1855 nt, Artificial Sequence
  mRNA product Design2 comprising derived and/or modified sequence from Lassa virus__AIT17584__GPC (opt1)
ggggcgcugccuacggagguggcagccaucuccuucucggcaucaagcuuaccaugggccagaucaucaccuucuuccaggaggugccccaggucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaaccaguccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacuccuucgcgguggacgccgccaaccacugcgggaccaucgccaacggcguccugcagaccuucaugcggauggcguggggcgggagcuacaucgcccuggacuccggcaaggggagcugggacugcaucaugaccuccuaccaguaccucaucauccagaacacgaccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucaugggcauccccuacugcaacuacagcaaguacugguaccugaaccacaccaagaccgggaagacgucccugccccgcugcuggcuggucagcaacggcuccuaccugaacgagacccacuucagcgacgacaucgagcagcaggccgacaacaugaucaccgagcuccugcagaaggaguacauggaccggcagggcaagaccccgcuggggcucguggaccuguucguguucuccacgagcuucuaccugaucuccaucuuccugcaccucgucaagaucccgacccaccgccacgugaucggcaagcccugccccaagccccaccggcugaaccacauggggaucugcagcugcggccuguacaagcacccgggggugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5481 - RNA, 1855 nt, Artificial Sequence
  mRNA product Design2 comprising derived and/or modified sequence from Lassa virus__AIT17588__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaaggccgaggcccagaugagcauccagcugaucaacaaggccgugaacgcgcugaucaacgaccagcucaucaugaagaaccaccuccgggacaucaugggcauccccuacugcaacuacuccaaguacugguaccugaaccacaccgucaccgggaagacgagccugccccgcugcuggcugguguccaacggcagcuaccugaacgagacccacuucuccgacgacaucgagcagcaggccgacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5482 - RNA, 1855 nt, Artificial Sequence
  mRNA product Design2 comprising derived and/or modified sequence from Lassa virus__AIT17592__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacacccugauguccaucaucagcaccuuccaccuguccauccccaacuucaaccaguacgaggccaugagcugcgacuucaacgggggccggaucuccgugcaguacaaccucagccacgccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacgaucaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacguggugggcaagcccugccccaagccccaccgccugaaccacauggggaucugcuccugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5483 - RNA, 1855 nt, Artificial Sequence
  mRNA product Design2 comprising derived and/or modified sequence from Lassa virus__AIT17596__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccuccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucaugggcaucccguacugcaacuacagcaaguacugguaccugaaccacaccgucacggggaagaccucccugccccgcugcuggcuggugagcaacggcuccuaccugaacgagacccacuucagcgacgacaucgagcagcaggccgacaacaugaucaccgagcuccugcagaaggaguacaucgaccggcagggcaagacgccccuggggcucguggaccuguucgucuucuccaccagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5484 - RNA, 1855 nt, Artificial Sequence
  mRNA product Design2 comprising derived and/or modified sequence from Lassa virus__AIT17600__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccggggacgccgccaaccacugcggcaccaucgcgaacggggugcugcagaccuucaugcggauggccuggggcggcuccuacaucgcccuggacagcgggaagggcuccugggacugcaucaugacgagcuaccaguaccucaucauccagaacaccaccugggaggaccacugccaguucucccgccccagccccaucggguaccugggccugcucagccagcggacccgcgacaucuacaucucccggcgccugcugggcacguucaccuggacccucagcgacuccgaggggaacgagaccccgggcggguacugccugacgcgguggaugcugaucgaggccgagcucaagugcuucggcaacaccgccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucauggggauccccuacugcaacuacuccaaguacugguaccugaaccacaccgugacgggcaagaccagccugccccgcugcuggcuggucuccaacggcagcuaccugaacgagacccacuucuccgacgacaucgagcagcaggcggacaacaugaucaccgagcuccugcagaaggaguacaucgaccggcaggggaagacgccccugggccucguggaccuguucguguucagcaccuccuucuaccugaucagcaucuuccugcaccucgucaagaucccgacccaccgccacgugaucgggaagcccugccccaagccccaccggcugaaccacaugggcaucugcuccugcgggcuguacaagcacccgggcgugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5485 - RNA, 1855 nt, Artificial Sequence
  mRNA product Design2 comprising derived and/or modified sequence from Lassa virus__AIT17604__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccagccucaacaugacgaugccgcuguccugcaccaagaacaacagccaccacuacaucauggucggcaacgagaccggccuggagcucacccugacgaacaccuccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgccguggacgcggccaagcacugcgggacgaucgccaacggcguccugcagaccuucaugcggauggccuggggcggguccuacaucgcgcuggacagcggcaagggguccugggacugcaucaugaccagcuaccaguaccucaucauccagaacaccacgugggaggaccacugccaguucucccgccccagccccgugggcuaccuggggcugcucagccagcggacccgcgacaucuacaucucccggcgccugcugggcaccuucaccuggacgcucagcgacuccgagggcaacgagacccccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagacggaggcgcagaugagcauccagcugaucaacaaggccgucaacgcccugaucaacgaccagcucaucaugaagaaccaccuccgggacaucaugggcauccccuacugcaacuacuccaaguacugguaccugaaccacaccgugaccgggaagaccagccugccccgcugcuggcugguguccaacggcagcuaccugaacgagacgcacuucuccgacgacaucgagcagcaggccgacaacaugaucaccgagcuccugcagaaggaguaccuggaccggcagggcaagaccccgcucgggcuggucgaccuguucguguucagcaccuccuucuaccugaucagcaucuuccuccaccuggugaagaucccgacgcaccgccacgucaucggcaagcccugccccaagccccaccggcugaaccacauggggaucugcuccugcggccucuacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5486 - RNA, 1855 nt, Artificial Sequence
  mRNA product Design2 comprising derived and/or modified sequence from Lassa virus__AIT17608__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacaaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggcggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5487 - RNA, 1855 nt, Artificial Sequence
  mRNA product Design2 comprising derived and/or modified sequence from Lassa virus__AIT17612__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacauccgggucggcaacgagaccggccuggagcucacccugaccaacacguccaucaucaaccacaaguucugcaaccugagcgacgcccacaagaagaaccucuacgaccacucccugaugagcaucaucuccaccuuccaccugagcauccccaacuucaaccaguacgaggccauguccugcgacuucaacgggggcaagaucagcgugcaguacaaccucucccacaccuacgccguggacgcggccaaccacugcgggaccaucgccaacggcguccugcagacguucaugcgcauggccuggggcgggagcuacaucgcgcuggacuccggcaaggggaacugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggccauccgccggcucaagaccgaggcgcagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacguggucggcaagcccugccccaagccccaccgccugaaccacauggggaucugcuccugcggccuguacaagcacccgggggugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5488 - RNA, 1855 nt, Artificial Sequence
  mRNA product Design2 comprising derived and/or modified sequence from Lassa virus__AIT17616__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacaucgaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5489 - RNA, 1855 nt, Artificial Sequence
  mRNA product Design2 comprising derived and/or modified sequence from Lassa virus__AIT17620__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucagccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacgcguacgccaucgacgccgccaaccacugcgggaccguggcgaacggcguccugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaaggccgaggcccagauguccauccagcugaucaacaaggccgugaacgcgcugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5490 - RNA, 1855 nt, Artificial Sequence
  mRNA product Design2 comprising derived and/or modified sequence from Lassa virus__AIT17626__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucauccagcacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucaccgugcaguacaaccucucccacagcuacgcgaucgacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggcgcaccagccugccccggugcuggcugguguccaacggcagcuaccugaacgagacccacuucuccgacgacaucgagcagcaggccgacaacaugaucacggagcuccugcagaaggaguacauggaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacaugggggugugcuccugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5491 - RNA, 1855 nt, Artificial Sequence
  mRNA product Design2 comprising derived and/or modified sequence from Lassa virus__AIT17630__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugcucuccuuccugcugcucugcggccgcagcugcuccacgaccuacaaggggguguacgagcugcagacccuggagcucgacauggccagccugaacaugaccaugccgcuguccugcacgaagaacaacagccaccacuacaucauggugggcaacgagaccggccucgagcugacccugaccaacacguccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacgcguacgccguggacgccgccgagcacugcgggaccaucgcgaacggcgugcugcagaccuucaugcggauggccuggggcggguccuacaucgcccucgacagcggcaagggguccugggacugcgucaugacgagcuaccaguaccugaucauccagaacaccuccugggaggaccacugccaguucagccgccccagccccaucggcuaccuggggcuccugucccagcggacccgcgacaucuacaucagccggcgccugcucggcaccuucacguggacccuguccgacagcgagggcaacgagacccccgggggcuacugccugacccgguggaugcucaucgaggccgagcugaagugcuucgggaacacggccguggcgaagugcaacgagaagcacgacgaggaguucugcgacaugcugcgccucuucgacuucaacaagcaggccauccggcgccugaagaccgaggcccagauguccauccagcugaucaacaaggccgugaacgcccucaucaacgaccagcugaucaugaagaaccaccuccgggacaucaugggcauccccuacugcaacuacagcaaguacugguaccugaaccacaccgucaccgggaagacgucccugccccgcugcuggcuggugagcaacggcuccuaccucaacgagacccacuucagcgacgacaucgagcagcaggcggacaacaugaucaccgagcugcugcagaaggaguacaucgaccggcagggcaagaccccgcucgggcugguggaccuguucgucuucuccacgagcuucuaccugaucuccaucuuccuccaccuggugaagaucccgacccaccgccacgugaucggcaagcccugccccaagccccaccggcugaaccacauggggaucugcagcugcggccucuacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5492 - RNA, 1855 nt, Artificial Sequence
  mRNA product Design2 comprising derived and/or modified sequence from Lassa virus__AIT17634__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaucuacaaggacguguacgagcuccagacccuggagcuggacauggccagccucaacaugaccaugccgcuguccugcaccaagaacaacagccaccacuacaucauggucgggaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacggcgggaagaucuccgugcaguacaaccucagccacaccuacgcgaucgacgccgccaaccacugcggcaccaucgccaacggggugcugcagaccuucaugcggauggcguggggcggguccuacaucgcccuggacagcggcaagggcuccugggacugcaucaugacgagcuaccaguaccucaucauccagaacaccaccugggaggaccacugccaguucucccgccccagccccaucggguaccugggccugcucagccagcggacccgcgacaucuacaucucccggcgccugcuggggacguucaccuggacccucagcgacuccgagggcaacgagaccccgggcggguacugccugacgcgguggaugcugaucgaggccgagcucaagugcuucggcaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucauggggauccccuacugcaacuacucccgcuacugguaccugaaccacaccgugacgggccggaccagccugccccgcugcuggcuggucuccaacgggagcuaccugaacgagacccacuucuccgacgacaucgagcagcaggccgacaacaugaucaccgagcuccugcagaaggaguacauggaccggcagggcaagacgccccugggccucguggaccuguucguguucagcaccuccuucuaccugaucagcaucuuccugcaccucgucaagaucccgacccaccgccacgugaucgggaagcccugccccaagccccaccggcugaaccacaugggcaucugcuccugcgggcuguacaaccacccgggcgugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5493 - RNA, 1855 nt, Artificial Sequence
  mRNA product Design2 comprising derived and/or modified sequence from Lassa virus__AIT17638__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucaucaagaucccgacccaccgccacaucacgggcaagcccugccccaagccccaccggcugaaccacauggggaucugcuccugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5494 - RNA, 1855 nt, Artificial Sequence
  mRNA product Design2 comprising derived and/or modified sequence from Lassa virus__AIT17642__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgacaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccgucgacgccgccucccacugcgggaccaucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggaagaccucccugccccgcugcuggcuggugagcaacggcuccuaccugaacgagacccacuucagcgacgacaucgagcagcaggcggacaacaugaucaccgagcuccugcagaaggaguacauggaccggcagggcaagacgccccuggggcucgucgaccuguucguguucuccaccagcuucuaccugaucuccaucuuccugcaccucgugaagaucccgacccaccgccacaucaucggcaagcccugccccaagccccaccggcugaaccacauggggaucugcagcugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5495 - RNA, 1855 nt, Artificial Sequence
  mRNA product Design2 comprising derived and/or modified sequence from Lassa virus__AIT17646__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccucccacugcgggaccgucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggaagaccucccugccccgcugcuggcuggugagcaacggcuccuaccugaacgagacccacuucagcgacgacaucgagcagcaggcggacaacaugaucaccgagcuccugcagaaggaguacauggaccggcagggcaagacgccccuggggcucgucgaccuguucguguucuccaccagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5496 - RNA, 1855 nt, Artificial Sequence
  mRNA product Design2 comprising derived and/or modified sequence from Lassa virus__AIT17650__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacaucuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaaggccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgucaccgggcgcacgagccugccccggugcuggcugguguccaacggcagcuaccugaacgagacccacuucuccgacgacaucgagcagcaggcggacaacaugaucaccgagcuccugcagaaggaguacaucgaccgccagggcaagaccccgcuggggcucguggaccuguucgucuucagcacguccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5497 - RNA, 1855 nt, Artificial Sequence
  mRNA product Design2 comprising derived and/or modified sequence from Lassa virus__AIT17658__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccaucacguacaagggggucuacgagcuccagacccuggagcuggacauggccaaccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcgugcaguacaaccucucccacaccuacgcgggggacgccgccgaccacugcggcaccaucgccaacgggguccugcagaccuucaugcggauggcguggggcggcagcuacaucgcccuggacuccgggaagggcagcugggacugcaucaugacguccuaccaguaccucaucauccagaacaccaccugggaggaccacugccaguucagccgccccucccccaugggguaccugggccugcucagccagcggacccgcgacaucuacaucagccggcgccugcugggcacguucaccuggacccucuccgacagcgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucauggggauccccuacugcaacuacagcaaguacugguaccugaaccacaccaucacgggcaagaccucccugccccgcugcuggcuggucagcaacggcuccuaccugaacgagacccacuucagcgacgacaucgagcagcaggccgacaacaugaucaccgagcuccugcagaaggaguacaucgaccggcaggggaagacgccccugggccucguggaccuguucguguucuccaccagcuucuaccugaucuccaucuuccugcaccucgucaagaucccgacccaccgccacaucaccgggaagcccugccccaagccccaccggcugaaccacaugggcaucugcagcugcgggcuguacaagcacccgggcgugcccgugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5498 - RNA, 1855 nt, Artificial Sequence
  mRNA product Design2 comprising derived and/or modified sequence from Lassa virus__AIT17666__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucgucgaccuguucguguucagcaccuccuucuaccugaucagcaucuuccugcaccucgugaagaucccgacccaccgccacaucacgggcaagcccugccccaagccccaccggcugaaccacauggggaucugcuccugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5499 - RNA, 1855 nt, Artificial Sequence
  mRNA product Design2 comprising derived and/or modified sequence from Lassa virus__AIT17670__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaaggccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggcgcaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5500 - RNA, 1855 nt, Artificial Sequence
  mRNA product Design2 comprising derived and/or modified sequence from Lassa virus__AIT17674__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacaaccacgcccugaugagcaucaucuccaccuuccaccugagcauccccaacuucaaccaguacgaggccauguccugcgacuucaacgggggcaagaucagcgugcaguacaaccucucccacagcuacgccguggacgcggccaaccacugcgggaccaucgccaacggcguccugcagacguucaugcggauggccuggggcggguccuacaucgcgcuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagaccgaggcgcaggccaacauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5501 - RNA, 1855 nt, Artificial Sequence
  mRNA product Design2 comprising derived and/or modified sequence from Lassa virus__AIT17678__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucacccucagccugcuggccauccucaaggggaucuacaacaucgccacgugcggccuguucgggcuggucuccuuccuccugcugugcggccgcagcugcuccaccaccuacaaggggguguacgagcuccagacccuggagcuggacaugacgagccucaacaugaccaugccgcuguccugcaccaagaacaacagccaccacuacaucauggugggcaacgagaccggccuggagcucacgcugaccaacaccuccaucaucaaccacaaguucugcaaccugagcgacgcgcacaagaagaaccucuacgaccacgcccugauguccaucaucagcaccuuccaccuguccauccccaacuucaaccaguacgaggccaugagcugcgacuucaacgggggcaagaucuccguccaguacaaccucagccacacguacgccguggacgccgcgaaccacugcgggaccaucgccaacggcgugcugcagaccuucaugcggauggccuggggcggguccuacaucgcccuggacagcggcaagggguccugggacugcaucaugaccagcuaccaguaccucaucauccagaacacgaccugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggcggagcucaagugcuucgggaacacggccgucgccaagugcaacgagaagcacgacgaggaguucugcgacaugcugcgccuguucgacuucaacaagcaggccauccggcgccucaagaccgaggcccagaugagcauccagcugaucaacaaggcggugaacgcccugaucaacgaccagcucaucaugaagaaccaccuccgggacaucaugggcauccccuacugcaacuacuccaaguacugguaccugaaccacaccgugaccgggaagacgagccugccccgcugcuggcuggucuccaacggcagcuaccugaacgagacccacuucuccgacgacaucgagcagcaggccgacaacaugaucaccgagcuccugcagaaggaguacaucgaccggcagggcaagaccccgcuggggcucguggaccuguucguguucagcacguccuucuaccugaucagcaucuuccugcaccucgucaagaucccgacccaccgccacaucaucggcaagcccugccccaagccccaccggcugaaccacauggggaucugcuccugcggccuguacaagcacccggggauccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5502 - RNA, 1855 nt, Artificial Sequence
  mRNA product Design2 comprising derived and/or modified sequence from Lassa virus__AIT17686__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaccaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagccgcaagggcuccugggacugcaucaugaccagcuaccaguaccucaucauccagaacaccaccugggaggaccacugccaguucucccggcccagccccaucggguaccugggccugcucagccagcgcacgcgggacaucuacaucucccgccggcugcuggggaccuucaccuggacccucagcgacuccgagggcaacgagacgccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucauggggauccccuacugcaacuacuccaaguacugguaccugaaccacacggucaccggcaagaccagccugccccggugcuggcugguguccaacgggagcuaccugaacgagacccacuucuccgacgacaucgagcagcaggccgacaacaugaucacggagcuccugcagaaggaguacauggaccgccagggcaagacgccccugggccucguggaccuguucgucuucagcaccuccuucuaccugaucagcaucuuccugcaccucaucaagaucccgacccaccggcacgugaucgggaagcccugccccaagccccaccgccugaaccacaugggcaucugcuccugcgggcuguacaagcacccgggcgugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5503 - RNA, 1855 nt, Artificial Sequence
  mRNA product Design2 comprising derived and/or modified sequence from Lassa virus__AIT17690__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccucccacugcgggaccgucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggcgcaccucccugccccggugcuggcuggugagcaacggcuccuaccugaacgagacccacuucagcgacgacaucgagcagcaggcggacaacaugaucaccgagcuccugcagaaggaguacauggaccgccagggcaagacgccccuggggcucgucgaccuguucguguucuccaccagcuucuaccugaucuccaucuuccugcaccucgugaagaucccgacccaccggcacgucaucggcaagcccugccccaagccccaccgccugaaccacauggggaucugcagcugcggccuguacaagcacccgggggugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5504 - RNA, 1855 nt, Artificial Sequence
  mRNA product Design2 comprising derived and/or modified sequence from Lassa virus__AIT17694__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaucuacaaggggguguacgagcuccagacccuggagcuggacauggccagccucaacaugaccaugccgcuguccugcaccaagaacaacagccaccacuacaucauggucggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggccgacaacaugaucaccgagcuccugcagaaggaguacaucgaccggcagggcaagacgccccuggggcucguggaccuguucgucuucagcaccuccuucuaccugaucagcaucuuccugcaccucgugaagaucccgacccaccgccacguggucggcaagcccugccccaagccccaccggcugaaccacauggggaucugcuccugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5505 - RNA, 1855 nt, Artificial Sequence
  mRNA product Design2 comprising derived and/or modified sequence from Lassa virus__AIT17712__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggggccugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccaucaugcggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggcggacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacgugaucggcaagcccugccccaagccccaccgccucaaccacauggggaucugcagcugcggccuguacaagcacccggggguccccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5506 - RNA, 1855 nt, Artificial Sequence
  mRNA product Design2 comprising derived and/or modified sequence from Lassa virus__AIT17718__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacauccgggucggcaacgagaccggccuggagcucacccugaccaacgccuccaucaucaaccacaaguucugcaaccugagcgacgcccacaagaagaaccucuacgaccacgcccugauguccaucaucagcacguuccaccuguccauccccaacuucaaccaguacgaggcgaugagcugcgacuucaacgggggcaagaucuccgugcaguacaaccucagccacgccuacgccaucgacgccgcgaaccacugcgggaccguggccaacggcguccugcagaccuucaugcgcauggccuggggcggguccuacaucgcccuggacagcggccgggggaacugggacugcaucaugaccuccuaccaguaccucaucauccagaacacgaccugggaggaccacugccaguucagccgccccucccccaucggcuaccuggggcugcucagccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggcgguggccaagugcaacgagaagcacgacgaggaguucugcgacaugcugcgccuguucgacuucaacaagcaggccauccggcgccucaagaccgaggcccagauguccauccagcugaucaacaaggccgugaacgcgcugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggcuucuacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5507 - RNA, 1855 nt, Artificial Sequence
  mRNA product Design2 comprising derived and/or modified sequence from Lassa virus__AIT17724__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgguggacgccgccaaccacugcgggaccgucgccaacggcgugcugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugccccgcugcuggcuggugagcaacggcuccuaccugaacgagacccacuucagcgacgacaucgagcagcaggccgacaacaugaucacggagcuccugcagaaggaguacauggaccggcagggcaagaccccgcuggggcucgucgaccuguucguguucuccaccagcuucuaccugaucuccaucuuccugcaccucgugaagaucccgacccaccgccacaucaugggcaagcccugccccaagccccaccggcugaaccacauggggaucugcagcugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5508 - RNA, 1855 nt, Artificial Sequence
  mRNA product Design2 comprising derived and/or modified sequence from Lassa virus__AIT17728__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaccaccuacaaggggguguacgagcuccagacccuggagcuggacaugggcagccucaacaugaccaugccgcuguccugcacgaagaacaacagccaccacuacaucauggucggcaacgagaccgggcuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacggcgggaagaucuccgugcaguacaaccucagccacaccuacgccguggacgcggccaaccacugcggcaccaucgccaacgggguccugcagacguucaugcggauggccuggggcggcuccuacaucgcgcuggacagcgggaagggcuccugggacugcaucaugaccagcuaccaguaccucaucauccagaacaccaccugggaggaccacugccaguucucccgccccagccccaucggguaccugggccugcucagccagcggacgcgcgacaucuacaucucccggcgccugcugggcaccuucaccuggacccucagcgacuccgaggggaacgagacgccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccggcgccucaagaccgaggcgcagaugagcauccagcugaucaacaaggccgugaacgcccugaucaacgaccagcucaucaugaagaaccaccuccgggacaucauggggauccccuacugcaacuacuccaaguacugguaccugaaccacacggucaccggcaagaccagccugccccgcugcuggcugguguccaacggcagcuaccugaacgagacccacuucuccgacgacaucgagcagcaggccgacaacaugaucacggagcuccugcagaaggaguacauggaccggcaggggaagacgccccugggccucguggaccuguucgucuucagcaccuccuucuaccugaucagcaucuuccugcaccucgugaagaucccgacccaccgccacgugaucgggaagcccugccccaagccccaccggcugaaccacaugggcaucugcuccugcgggcuguacaagcacccgggcguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5509 - RNA, 1855 nt, Artificial Sequence
  mRNA product Design2 comprising derived and/or modified sequence from Lassa virus__AIT17732__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacaucgugggcaagcccugccccaagccccaccggcugaaccacauggggaucugcuccugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5510 - RNA, 1855 nt, Artificial Sequence
  mRNA product Design2 comprising derived and/or modified sequence from Lassa virus__AIT17736__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaugcggcucaagaccgaggcccagaugagcauccagcugaucaacaaggccgucaacgcccugaucaacgaccagcucaucaugaagaaccaccuccgcgacaucaugggcauccccuacugcaacuacuccaaguacugguaccugaaccacacggugaccgggaagaccagccugccccggugcuggcugguguccaacggcagcuaccugaacgagacccgcuucuccgacgacaucgagcagcaggccgacaacaugaucacggagaugcuccagaaggaguaccuggaccggcagggcaagaccccgcuggggcucgucgaccuguucguguucagcaccuccuucuaccugaucagcaucuuccugcaccucgugaagaucccgacccaccgccacaucaucggcaagcccugccccaagccccaccggcugaaccacauggggaucugcuccugcggccuguacaagcacccggggguccccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5511 - RNA, 1855 nt, Artificial Sequence
  mRNA product Design2 comprising derived and/or modified sequence from Lassa virus__AIT17744__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugauguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggugggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacgcguacgccguggacgccgccaaccacugcgggaccaucgcgaacggcgugcugcagaccuucaugcggauggccuggggcgggagcuacaucgcccuggacuccggcaaggggagcugggacugcaucaugacguccuaccaguaccucaucauccagaacaccagcugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggccgagcucaagugcuucgggaacacggccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgugaccgggaagacgagccugccccgcugcuggcuggucuccaacggcagcuaccugaacgagacccacuucuccgacgacaucgagcagcaggcggacaacaugaucaccgagcuccugcagaaggaguacaucgaccggcagggcaagaccccgcuggggcucguggaccuguucguguucagcacguccuucuaccugaucagcaucuuccugcaccucgucaagaucccgacccaccgccacgugaucggcaagcccugccccaagccccaccggcugaaccacauggggaucugcuccugcggccuguacaagcacccgggggugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5512 - RNA, 1855 nt, Artificial Sequence
  mRNA product Design2 comprising derived and/or modified sequence from Lassa virus__AIT17752__GPC (opt1)
ggggcgcugccuacggagguggcagccaucuccuucucggcaucaagcuuaccaugggccagaucaucaccuucuuccacgaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggccgcggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccgucgccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggugaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5513 - RNA, 1855 nt, Artificial Sequence
  mRNA product Design2 comprising derived and/or modified sequence from Lassa virus__AIT17756__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaucacguacaaggggguguacgagcuccagacccuggagcuggacauggccagccucaacaugaccaugccgcuguccugcaccaagaacaacagccaccacuacaucauggucggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggccgcggguccugggacugcaucaugacgagcuaccaguaccucaucauccagaacaccaccugggaggaccacugccaguucucccggcccagccccaucggcuaccuggggcugcucagccagcgcacccgggacaucuacaucucccgccggcugcugggcacguucaccuggacccucagcgacuccgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacaccgucaccgggcggacgagccugccccgcugcuggcugguguccaacggcagcuaccugaacgagacccacuucuccgacgacaucgagcagcaggcggacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacaucaucggcaagcccugccccaagccccaccggcugaaccacauggggaucugcuccugcggccuguacaagcacccgggggugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5514 - RNA, 1855 nt, Artificial Sequence
  mRNA product Design2 comprising derived and/or modified sequence from Lassa virus__AIT17758__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcugaacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugcgaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccgucacggggaagaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5515 - RNA, 1855 nt, Artificial Sequence
  mRNA product Design2 comprising derived and/or modified sequence from Lassa virus__AIT17762__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucagccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgguggacgccgccaaccacugcgggaccaucgccaacggcguccugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccagccccaucggcuaccuggggcugcucucccagcggacgcgcgacaucuacaucagccggcgccugcugggcaccuucaccuggacccucuccgacagcgagggcaacgaggcccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgugaacgcccugaucaacgaccagcucaucaugaagaaccaccuccgggacaucaugggcaucccguacugcaacuacagccgcuacugguaccugaaccacaccgucacggggaagaccucccugccccggugcuggcuggugagcaacggcuccuaccugaacgagacccacuucagcgacgacaucgagcagcaggcggacaacaugaucaccgagcuccugcagaaggaguacauggaccgccagggcaagacgccccuggggcucguggaccuguucgucuucuccaccagcuucuaccugaucuccaucuuccugcaccucgugaagaucccgacccaccggcacgugaucggcaagcccugccccaagccccaccgccugaaccacauggggaucugcagcugcggccuguacaagcacccggggguccccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5516 - RNA, 1855 nt, Artificial Sequence
  mRNA product Design2 comprising derived and/or modified sequence from Lassa virus__AIT17770__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccaggcccuggagcuggacaugagcucccucaacaugaccaugccgcugagcugcaccaagaacaacucccaccacuacaucauggugggcaacgagacgggccuggagcucacccugaccaacaccagcaucauccaccacaaguucugcaaccuguccgacgcccacaagaaggaccucuacgaccacgcccugaugagcaucaucuccacguuccaccugagcauccccaacuucaaccaguacgaggccauguccugcgacuucaacgggggcaagaucagcgugcaguacaaccucucccacaccuacgcggucgacgccgccaaccacugcgggaccaucgccaacggcgugcugcagaccuucaugcggauggcguggggcgggagcuacaucgcccuggacuccggcaagggcgggugggacugcaucaugacgagcuaccaguuccucaucauccagaacaccaccugggaggaccacugccaguucucccgccccagccccaucggguaccugggccugcucagccagcggacccgcgacaucuacaucucccggcgccugcugggcacguucaccuggacccucagcgacuccgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggcgaucaagcggcucaagaccgaggcccagaugagcauccaccugaucaacaaggccgucaacgcccugaucaacgaccagcucaucaugaagaaccaccuccgcgacaucauggggauccccuacugcaacuacuccaaguacugguaccugaaccacaccgugacgggcaagaccagccugccccggugcuggcugguguccaacggcagcuaccugaacgagacccacuucuccgacgacaucgagcagcaggccgacaacaugaucaccgagcuccugcagaaggaguacaucgaccgccaggggaagacgccccugggccucgucgaccuguucguguucagcaccuccuucuaccugaucagcaucuuccugcaccucgugaagaucccgacccaccggcacgucaucgggaagcccugccccaagccccaccgccugaaccacaugggcaucugcuccugcgggcuguacaagcacccgggcgugcccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5517 - RNA, 1855 nt, Artificial Sequence
  mRNA product Design2 comprising derived and/or modified sequence from Lassa virus__AIT17778__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgcgggacgccgccaaccacugcgggaccaucgccaacggcgugcugcagacguucaugcgcauggcguggggcgggagcuacaucgcccuggacuccggcaaggggagcugggacugcaucaugaccuccuaccaguaccucaucauccagaacaccaccugggaggaccacugccaguucagccggcccucccccaucggcuaccuggggcugcucagccagcgcacgcgggacaucuacaucagccgccggcugcugggcaccuucaccuggacccucuccgacagcgagggcaacgagacgcccgggggcuacugccugacccgcuggaugcugaucgaggccgagcucaagugcuucgggaacaccgccgucgccaagugcaacgagaagcacgacgaggaguucugcgacaugcugcggcuguucgacuucaacaagcaggcgauccgccggcucaagaccgaggcccagaugaacauccagcugaucaacaaggccgugaacgcccugaucaacgaccagcucaucaugaagaaccaccuccgcgacaucaugggcauccccuacugcaacuacuccaaguacugguaccugaaccacacggugaccgggaagaccagccugccccggugcuggcuggucuccaacggcagcuaccugaacgagacccacuucuccgacgacaucgagcagcaggccgacaacaugaucacggagcuccugcagaaggaguacauggaccgccagggcaagaccccgcuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5518 - RNA, 1855 nt, Artificial Sequence
  mRNA product Design2 comprising derived and/or modified sequence from Lassa virus__AIT17782__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaagcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacguggucggcaagcccugccccaagccccaccgccugaaccacauggggaucugcuccugcggccuguacaagcacccgggggugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5519 - RNA, 1855 nt, Artificial Sequence
  mRNA product Design2 comprising derived and/or modified sequence from Lassa virus__AIT17786__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccaucgacgccgccgaccacugcgggaccaucgcgaacggcgugcugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgugacggggaagaccagccugccccgcugcuggcuggucuccaacggcagcuaccugaacgagacccacuucuccgacgacaucgagcagcaggcggacaacaugaucaccgagcuccugcagaaggaguacauggaccggcagggcaagacgccccuggggcucguggaccuguucguguucagcaccuccuucuaccugaucagcaucuuccugcaccucgucaagaucccgacccaccgccacaucaccggcaagcccugccccaagccccaccggcugaaccacauggggaucugcuccugcggccuguacaagcacccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5520 - RNA, 1855 nt, Artificial Sequence
  mRNA product Design2 comprising derived and/or modified sequence from Lassa virus__AIT17790__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucgugaagaucccgacccaccgccacaucacgggcaagcccugccccaagccccaccggcugaaccacauggggaucugcuccugcggccuguacaagcacccgggggugcccgucaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5521 - RNA, 1855 nt, Artificial Sequence
  mRNA product Design2 comprising derived and/or modified sequence from Lassa virus__AIT17798__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaugcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagaugcuccagaaggaguaccuggaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5522 - RNA, 1858 nt, Artificial Sequence
  mRNA product Design2 comprising derived and/or modified sequence from Lassa virus__AIT17802__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacaaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcgaccggugggacugcaucaugaccagcuaccaguaccugaucauccagaacaccacgugggaggaccacugccaguucucccgccccagccccaucggcuaccucgggcugcugucccagcggacccgcgacaucuacaucagccggcgccuccugggcaccuucaccuggacgcugagcgacuccgagggcaaggacacccccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcauccccuacugcaacuacuccaaguacugguaccugaaccacacgaccaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcucggcaagaccccgcuggggcuggucgaccuguucguguucagcaccuccuucuaccucaucagcaucuuccugcaccuggugaagaucccgacgcaccgccacaucgucggccgguccugccccaagccccaccgccucaaccacauggggaucugcagcugcggccuguacaagcagcccggggugccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5523 - RNA, 1858 nt, Artificial Sequence
  mRNA product Design2 comprising derived and/or modified sequence from Lassa virus__AIT17806__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggcaagugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5524 - RNA, 1858 nt, Artificial Sequence
  mRNA product Design2 comprising derived and/or modified sequence from Lassa virus__AIT17810__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaaggacaacagccaccacuacauccgggugggcaacgagaccggccuggagcugacgcucaccaacaccuccauccugaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggccgcaucuccguccaguacaaccucagccacuccuacgccggggacgcggccaaccacugcggcacgguggccaacggggugcugcagaccuucaugcggauggccuggggcggcagcuacaucgcgcuggacuccgggcgcggccggugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugccccggugcuggcugguguccaacggcagcuaccugaacgagacgcacuucuccgacgacaucgagcagcaggccgacaacaugaucaccgagaugcuccagaaggaguacauggagcgccaggggaagacgccccugggccuggucgaccuguucguguucagcaccuccuucuaccucaucagcaucuuccugcaccuggugaagaucccgacccaccggcacgucguggggaagcccugccccaagccccaccgccucaaccacaugggcaucugcuccugcgggcuguacaagcagccgggcgugcccgucaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5525 - RNA, 1858 nt, Artificial Sequence
  mRNA product Design2 comprising derived and/or modified sequence from Lassa virus__AIT17814__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucgaccacaaguucugcaaccucagcgacgcccaccggaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccaaggacgcggccgaccacugcgggacgguggccaacggcgugcugcagaccuucaugcgcauggccuggggcgggagcuacaucgcgcucgacuccggccgggggcgcugggacugcaucaugaccagcuaccaguaccugaucauccagaacaccacgugggaggaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcgccagggcaagaccccgcuggggcucgucgaccuguucguguucagcaccuccuucuaccugaucagcaucuuccugcaccucgugaagaucccgacgcaccggcacaucgucggcaagcccugccccaagccccaccgccugaaccacauggggaucugcuccugcggccuguacaagcagccgggggugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5526 - RNA, 1858 nt, Artificial Sequence
  mRNA product Design2 comprising derived and/or modified sequence from Lassa virus__AIT17820__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccgaggacgcggccaaccacugcgggacgguggccaacggcgugcugcagaccuucaugcggauggccuggggcgggagcuacaucgcgcucgacuccggccgcgggaacugggacugcaucaugaccagcuaccaguaccugaucauccagaacaccacgugggaggaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcgccagggcaagaccccgcuggggcucgucgaccuguucguguucagcaccuccuucuaccugaucagcaucuuccugcaccucgugaagaucccgacgcaccggcacaucgucggcaaguccugccccaagccccaccgccugaaccacauggggaucugcagcugcggccuguacaagcagcccggggugccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5527 - RNA, 1858 nt, Artificial Sequence
  mRNA product Design2 comprising derived and/or modified sequence from Lassa virus__AIT17824__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagcguguacaaggggguguacgagcuccagacccuggagcugaacauggagacgcucaacaugaccaugccgcuguccugcaccaagaacaacagccaccacuacaucauggucggcaacgagaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacuccuacgccggggacgcggccaaccacugcggcacgguggccaacgggguccugcagaccuucaugcggauggccuggggcggcagcuacaucgcgcuggacuccgggcacggcaagugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugcccaagugcuggcuggucuccaacggcagcuaccugaacgagacgcacuucuccgacgacaucgagcagcaggccgacaacaugaucaccgagaugcuccagaaggaguacauggagcggcaggggaagacgccccugggccugguggaccucuucguguucagcaccuccuucuaccugaucagcaucuuccugcaccuggucaagaucccgacccaccgccacaucguggggaaguccugccccaagccccaccggcucaaccacaugggcaucugcagcugcgggcuguacaagcagcccggcgugccgguccgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5528 - RNA, 1858 nt, Artificial Sequence
  mRNA product Design2 comprising derived and/or modified sequence from Lassa virus__AIT17828__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaagggggacuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5529 - RNA, 1855 nt, Artificial Sequence
  mRNA product Design2 comprising derived and/or modified sequence from Lassa virus__AIT17836__GPC (opt1) R6026/R6631
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaaggggcuguacaacaucgcgaccugcggcaucaucgggcuggucgccuuccucuuccugugcggcaaguccugcagccugacgcucaagggcggguacgagcugcagacccuggagcucaacauggagacccugaacaugaccaugccgcuguccugcacgaagaacagcucccaccacuacauccgcgugggcaacgagaccgggcucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacggcgggaagaucagcgugcaguacaaccugucccacagcuacgcgggcgacgccgccgagcacugcgggaccgucgccaacggcgugcugcagaccuucaugcggauggcguggggcgggcgcuacaucgcccucgacuccggcaaggggaacugggacugcaucaugacgagcuaccaguaccugaucauccagaacaccaccugggaggaccacugccaguucucccggcccagccccaucggcuaccugggccuccugucccagcgcacccgggacaucuacaucagccgccggcugcucgggacguucaccuggacccugagcgacuccgagggcaacgagacccccgggggcuacugccugacgcgcuggaugcucaucgaggccgagcugaagugcuucgggaacaccgccguggccaagugcaacgagaagcacgacgaggaguucugcgacaugcugcggcuguucgacuucaacaagcaggcgauccgccggcugaaggccgaggcccagaugagcauccagcugaucaacaaggccgucaacgcccucaucaacgaccagcugaucaugaagaaccaccuccgcgacaucaugggcauccccuacugcaacuacuccaaguacugguaccucaaccacaccagcuccggccggaccagccugcccaagugcuggcugaucuccaacgggagcuaccucaacgagacgcaguucuccgacgacaucgagcagcaggcggacaacaugaucaccgagaugcugcagaaggaguacaucgagcgccagggcaagaccccgcuggggcucguggacaucuucaucuucagcaccuccuucuaccugaucagcaucuuccugcaccugaucaagaucccgacgcaccggcacaucgugggcaagcccugccccaagccccaccgccucaaccacaugggggucugcuccugcggccuguacaagcacccgggcgugcccaccaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5530 - RNA, 1858 nt, Artificial Sequence
  mRNA product Design2 comprising derived and/or modified sequence from Lassa virus__AIT17840__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaucagccucuacaaggggguguacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcgaccggugggacugcaucaugaccagcuaccaguaccugaucauccagaacaccaccugggaggaccacugccaguucucccgccccagccccaucggcuaccuggggcuccugucccagcggacgcgcgacaucuacaucagccggcgccugcucggcaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacaccacgaccgggaagaccagccugcccaagugcuggcugguguccaacggcagcuaccucaacgagacccacuucuccgacgacaucgagcagcaggccgacaacaugaucacggagaugcugcagaaggaguacauggagcggcagggcaagaccccgcuggggcucgucgaccuguucguguucagcaccuccuucuaccugaucagcaucuuccugcaccucgugaagaucccgacccaccgccacaucgucggcaagcccugccccaagccccaccggcugaaccacauggggaucugcuccugcggccuguacaagcagccgggggugcccgugaaguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5531 - RNA, 1858 nt, Artificial Sequence
  mRNA product Design2 comprising derived and/or modified sequence from Lassa virus__AIT17844__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaucagccucuacaaggggguguacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcgaccggugggacugcaucaugaccagcuaccaguaccugaucauccagaacaccaccugggaggaccacugccaguucucccgccccagccccaucggcuaccuggggcuccugucccagcggacgcgcgacaucuacaucagccggcgccugcucggcaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaaccgcgccgugaacgcccucaucaacgaccagcugaucaugaagaaccaccuccgggacaucaugggcauccccuacugcaacuacuccaaguacugguaccugaaccacaccacgaccgggaagaccagccugcccaagugcuggcugguguccaacggcagcuaccucaacgagacccacuucuccgacgacaucgagcagcaggccgacaacaugaucacggagaugcugcagaaggaguacauggagcgccagggcaagaccccgcuggggcucgucgaccuguucguguucagcaccuccuucuaccugaucagcaucuuccugcaccucgugaagaucccgacccaccggcacaucgucggcaagcccugccccaagccccaccgccugaaccacauggggaucugcuccugcggccuguacaagcagccgggggugcccgugaaguggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5532 - RNA, 1855 nt, Artificial Sequence
  mRNA product Design2 comprising derived and/or modified sequence from Lassa virus__AMR44577__GPC (opt1)
ggggcgcugccuacggagguggcagccaucuccuucucggcaucaagcuuaccaugggccagaucaucaccuucuuccaggaggugccccacgucaucgaggaggugaugaacaucgugcugaucgcccucagccugcuggccauccucaagggggucuacaacguggcgaccugcggcaucaucgggcuggugacguuccuguuccucugcggccgcuccugcagccugaucuacaagggguccuacgagcugcagacccucgagcugaacauggagacccugaacaugaccaugccgcucagcugcacgaagaacuccagccaccacuacauccgggucggcaacgagaccggccuggagcugacccucaccaacacguccaucaucaaccacaaguucugcaaccugagcgacgcccacaagcgcaaccuguacgaccacgcccucauguccauccugagcaccuuccaccuguccauccccaacuucaaccaguacgaggccaugagcugcgacuucaacgggggcaagaucuccgugcaguacaaccucagccacgccuacgcgguggacgccgccgagcacugcgggaccgucgccaacggcgugcugcagaccuucaugcggauggcguggggcggguccuacaucgcccuggacagcggccgcgggaacugggacugcaucaugacguccuaccaguaccucaucauccagaacaccaccugggaggaccacugccaguucagccggcccucccccaucggcuaccuggggcugcucagccagcgcacccgggacaucuacaucagccgccggcugcugggcacguucaccuggacccucuccgacagcgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccagcgccucaaguccgaggcccagaugagcauccagcugaucaacaaggccgucaacgcccugaucaacgaccagcucaucaugaagaaccaccuccgggacaugaugggcauccccuacugcaacuacuccaaguacugguaccugaaccacaccagcuccgggcgcaccagccugcccaagugcuggcugguguccaacggcagcuaccugaacgagacgcacuucuccgacgacaucgagcagcaggccgacaacaugaucaccgagaugcuccagaaggaguacaucgaccggcagggcaagaccccgcuggggcugguggaccucuucgucuucagcaccuccuucuaccugaucagcaucuuccugcaccugaucaagaucccgacgcaccgccacaucgugggcaagcccugccccaagccccaccggcucaaccacauggggaucugcuccugcggccuguacaagcagccgggggugcccacccgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5533 - RNA, 1858 nt, Artificial Sequence
  mRNA product Design2 comprising derived and/or modified sequence from Lassa virus__ANH09722__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagccucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgacgggaagaucagcguccaguacaaccugucccacacguacgcgggcgacaccgccaaccacugcgggaccguggccaacggcgugcuccagaccuucaugcgcauggccuggggcgggagcuacaucgcgcuggacuccggccgcgggggcugggacugcaucaugacgagcuaccaguaccugaucauccagaacaccaccugggaggaccacugccaguucucccggcccagccccaucggguaccucggccugcugucccagcggacccgcgacaucuacaucagccggcgccuccugggcacguucaccuggacccuguccgacagcgaggggaaggacaccccgggcggguacugccucacgcgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucauggggauccccuacugcaacuacuccaaguacugguaccugaaccacaccgugaccggcaagacgagccugcccaagugcuggcucgucuccaacggcagcuaccugaacgagacccacuucuccgacgacaucgagcagcaggccgacaacaugaucaccgagaugcugcagaaggaguacauggagcggcaggggaagacgccccucggccugguggaccuguucguguucagcaccuccuucuaccugaucagcaucuuccuccaccuggucaagaucccgacccaccgccacgugguggggaagcccugccccaagccccaccggcugaaccacaugggcaucugcuccugcggguucuacaagcagccgggcguccccgugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5534 - RNA, 1858 nt, Artificial Sequence
  mRNA product Design2 comprising derived and/or modified sequence from Lassa virus__ANH09724__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacgacucccaccacuacaucauggugggcaacgagaccggccucgagcugacgcugaccaacaccagcaucaucucccacaaguucugcaaccucagcgacgcccacaagcagaaccuguacgaccacgcccugauguccaucaucagcaccuuccaccucuccauccccaacuucaaccaguacgaggccaugagcugcgacuucaacgggggcaagaucuccguccaguacaaccugagccacacguacgcgggggacgccgccaaccacugcggcaccguggccaacggggugcugcagaccuucaugcggauggcguggggcggcuccuacaucgcccucgacagcgggcgcggcgggugggacugcaucaugaccuccuaccaguaccugaucauccagaacacgaccugggaggaccacugccaguucagccggcccucccccaucggcuaccugggccuccugagccagcgcacccgggacaucuacaucucccgccggcugcucgggaccuucacguggacccugagcgacagcgagggcaaggacacccccgggggcuacugccugacccgcuggaugcucaucgaggccgagcugaagugcuucgggaacacggccgucgccaagugcaacgagaagcacgacgaggaguucugcgacaugcugcggcuguucgacuucaacaagcaggcgauccagcgccugaaggccgaggcccagauguccauccagcugaucaacaaggccgugaacgcccucaucaacgaccagcugaucaugaagaaccaccuccgggacaucaugggcauccccuacugcaacuacagcaaguacugguaccucaaccacaccgugaccggcaagaccucccugcccaagugcuggcuggucagcaacggguccuaccucaacgagacgcacuucagcgacgacaucgagcagcaggcggacaacaugaucaccgagaugcugcagaaggaguacauggagcgccagggcaagaccccgcuggggcucguggaccuguucguguucuccaccagcuucuaccugaucuccaucuuccugcaccucgucaagaucccgacgcaccggcacguggugggcaagcccugccccaagccccaccgccugaaccacauggggaucugcagcugcggcuucuacggccagccggggguccccgugcgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5535 - RNA, 1858 nt, Artificial Sequence
  mRNA product Design2 comprising derived and/or modified sequence from Lassa virus__ANH09728__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcgugcuggccgugcugaaggggcucuacaacgucgcgaccugcggccugaucgggcuggugacguuccuccugcugugcggccgcuccugcaccaccacccucuacaaggggguguacgagcugcaggcccuggagcucaacaugggcacgcugaacaugaccaugccgcugagcugcaccaagaacaacucccaccacuacaucauggucggcaacgagaccgggcucgagcugacgcugaccaacaccagcaucaucaaccacaaguucugcaaccucuccgacgcccacaagaaggaccuguacgaccacgcccugaugagcaucaucuccaccuuccaccucagcgugcccaacuucaaccaguacgaggccauguccugcgacuucaacggcgggaagaucagcgugcaguacaaccugucccacgcguacgccggcgacacggccaaccacugcgggaccgucgccaacggcgugcugcagaccuucaugcggauggcguggggcgggagcuacaucgcccucgacuccggccgcgggggcugggacugcaucaugaccagcuaccaguaccugaucauccagaacacgaccugggaggaccacugccaguucucccggcccagccccaucggcuaccuggggcuccugucccagcgcacccgggacaucuacaucagccgccggcugcucggcaccuucacguggacccuguccgacagcgagggggaguacaccccgggcggguacugccugacccgcuggaugcucaucgaggccgagcugaagugcuucggcaacacggccguggccaagugcaacgagaagcacgacgaggaguucugcgacaugcugcggcuguucgacuucaacaagcaggcgauccagcgccugaaggccgaggcccagaugagcauccagcugaucaacaaggccgucaacgcccucaucaacgaccagcugaucaugaagaaccaccuccgggacaucaugggcauccccuacugcaacuacuccaaguacugguaccucaaccacaccgugaccgggaagaccagccugcccaagugcuggcugguguccaacggcagcuaccucaacgagacgcacuucuccgacgacaucgagcagcaggcggacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacgucguggggaagcccugccccaagccccaccgccugaaccacaugggcaucugcuccugcggcuucuacaagcagccgggggugcccguccgguggaagcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5536 - RNA, 1858 nt, Artificial Sequence
  mRNA product Design2 comprising derived and/or modified sequence from Lassa virus__ANH09730__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcgugcuggccgugcugaaggggcucuacaacgucgcgaccugcggccugaucgggcuggugacguuccuccugcugugcggccgcuccugcaccaccacccucuacaaggggguguacgagcugcaggcccuggagcucaacauggagacgcugaacaugaccaugccgcugagcugcaccaagaacaacucccaccacuacaucauggucggcaacgagaccggccucgagcugacgcugaccaacaccagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaaccaggggaagaucagcgugcaguacaaccugucccacgcguacgccggcgacgccgccaaccacugcgggacgguggcgaacggcguccugcagaccuucaugcggauggccuggggcgggagcuacaucgcccucgacuccggccgcgggggcugggacugcaucaugaccagcuaccaguaccugaucauccagaacaccacgugggagaaccacugccaguucucccggcccagccccaucggguaccugggccuccugucccagcgcacccgggacaucuacaucagccgccggcugcucggcaccuucaccuggacgcuguccgacagcgaggggaagggcacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgcuucaaggccgaggcccagaugagcauccagcugaucaacaaggccgugaacgcgcugaucaacgaccagcucaucaugaagaaccaccuccgggacaucaugggcauccccuacugcaacuacuccaaguacugguaccugaaccacacggucaccggcaagaccagccuccccaagugcuggcugguguccaacgggagcuaccugaacgagacccacuucuccgacgacaucgagcagcaggccgacaacaugaucacggagaugcuccagaaggaguacauggagcgccagggccggaccccgcuggggcugguggaccucuucgucuucagcaccuccuucuaccugaucagcaucuuccugcaccuggugaagaucccgacccaccgccacguggucggcaagcccugccccaagccccaccggcucaaccacauggggaucugcuccugcggcuucuacaagcagccgggcgugcccgugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5537 - RNA, 1858 nt, Artificial Sequence
  mRNA product Design2 comprising derived and/or modified sequence from Lassa virus__ANH09732__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccgugcugaaggggguguacaacgucgcgaccugcggccucaucgggcuggugacguuccugcuccuguccggccgcagcugcaccaccaccaucuacaaggggguguacgagcugcaggcccucgagcugaacauggagacgcugaacaugaccaugccgcucuccugcaccaagaacaacagccaccacuacaucauggucggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacacguacgcgggggacgccgccaaccacugcggcaccguggccaacgggguccuccagaccuucaugcggauggcguggggcggcuccuacaucgcccuggacagcgggcacggcgggugggacugcaucaugaccuccuaccaguaccugaucauccagaacacgaccugggagaaccacugccaguucagccgccccucccccaucggcuaccucggccugcugagccagcggacccgcgacaucuacaucucccggcgccuccuggggaccuucacguggacccugagcgacagcgagggcaaggacacccccgggggcuacugccucacccgguggaugcugaucgaggccgagcugaagugcuucgggaacacggccguggccaagugcaacgagaagcacgacgaggaguucugcgacaugcuccgccuguucgacuucaacaagcaggcgauccagcggcugaaggccgaggcccagauguccauccagcucaucaacaaggccgugaacgcccugaucaacgaccagcugaucaugaagaaccaccuccgcgacaucaugggcauccccuacugcaacuacagcaaguacugguaccugaaccacaccgucaccggcaagaccucccugcccaagugcuggcucgugagcaacggguccuaccugaacgagacgcacuucagcgacgacaucgagcagcaggcggacaacaugaucaccgagaugcugcagaaggaguacauggagcggcagggcaagaccccgcucgggcugguggaccuguucgucuucuccaccagcuucuaccucaucuccaucuuccugcaccuggugaagaucccgacgcaccgccacaucgugggcaagcccugccccaagccccaccggcugaaccacauggggaucugcagcugcggcuucuacaagcagccgggcguccccgugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5538 - RNA, 1855 nt, Artificial Sequence
  mRNA product Design2 comprising derived and/or modified sequence from Lassa virus__ANH09738__GPC (opt1)
ggggcgcugccuacggagguggcagccaucuccuucucggcaucaagcuuaccaugggccagaucgugaccuucuuccaggaggucccccacgugaucgaggagaucaugaacaucgugcugaucacccucagccugcuggccauccucaaggggcuguacaacuucgccacgugcggccugaucgggcucaucaccuuccuguuccugugcggccgcuccugcagcaugaucuacaagggguccuaccagcucgagacccuggagcugaacauggagacccucaacaugacgaugccgcugagcugcaccaagaacaacucccaccacuacauccgggucggcaacgagaccggccuggagcucacccugacgaacaccagcaucaucaaccacaaguucugcaaccuguccgacgcgcacaagcgcaaccucuacgaccacagccugauguccaucaucagcaccuuccaccuguccauccccaacuucaaccaguacgaggccaugagcugcgacuucaacgggggcaagaucuccauccaguacaaccucagccacaccuacgccggggacgccgccaagcacugcggcacgguggcgaacggggugcugcagaccuucaugcggauggccuggggcggcuccuacaucgcccuggacagcgggcgcggcaacugggacugcaucaugaccuccuaccaguaccucaucauccagaacaccacgugggaggaccacugccaguucagccggcccucccccaucggguaccugggccugcucagccagcgcacccgggacaucuacaucagccgccggcugcugggcaccuucaccuggacgcucuccgacagcgaggggaaggagaccccgggcggguacugccugacccgcuggaugcugaucgaggccgagcucaagugcuucggcaacaccgcggucgccaagugcaacgagaagcacgacgaggaguucugcgacaugcugcggcuguucgacuucaacaagcaggccauccagcgccucaagacggaggcccagauguccauccagcugaucaacaaggccgugaacgcgcugaucaacgaccagcucaucaugaagaaccaccuccgggacaucauggggauccccuacugcaacuacagcaaguacugguaccugaaccacaccuccaccggccgcaccagccugcccaagugcuggcugguguccaacggcagcuaccugaacgagacgcacuucuccgacgacaucgagcagcaggccgacaacaugaucaccgagaugcuccagaaggaguacaucgaccggcaggggaagacgccccugggccuggucgacguguucauguucagcaccuccuucuaccucaucagcaucuuccugcaccuggugaagaucccgacccaccgccacaucgucgggaaguccugccccaagccccaccggcugaaccacaugggcaucugcagcugcgggcucuacaagcagcccggcgugccggugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5539 - RNA, 1855 nt, Artificial Sequence
  mRNA product Design2 comprising derived and/or modified sequence from Lassa virus__ANH09740__GPC (opt1)
ggggcgcugccuacggagguggcagccaucuccuucucggcaucaagcuuaccaugggccagaucgugaccuucuuccaggaggucccccacgugaucgaggaggugaugaacaucguccugaucgcccucagccugcuggccauccucaaggggcuguacaacuucgcgaccugcggcgugaucgggcugaucacguuccuccugcugugcggccgcuccugcagcgccaccuacaaggggcaguacgagcuccagacccuggagcugaacauggagucccucaacaugaccaugccgcugagcugcacgaagaacaacucccaccacuacauccgggccggcaacaacaccggccuggagcucacccugaccaacacgagcaucaucucccacaaguucugcaaccugagcgacgcccacaagaagaaccucuacgaccacacccugauguccaucaucaccaccuuccaccugagcauccccaacuucaaccaguacgaggccauguccugcgacuucaacgggggcaagaucagcauccaguacaaccucucccacagcuacgcgggggacgccgcccagcacugcggcacgguggccaacgggguccugcagaccuucaugcgcauggcguggggcggcuccuaccuggcccucgacagcgggcggcgcggcugggacugcaucaucuccagcuaccaguaccugaucauccagaacaccaccugggacgaccacugccaguucucccggcccagccccaucggguaccugggcuucgugagccagaagacgcgcgacaucuacaucucccggcgccuccugggcaccuucaccuggacccugagcgacuccgaggggcacgacaugccgggcggguacugccucacgcgguggaugcugaucgaggccgaccugaagugcuucggcaacaccgccguggccaagugcaacgagaagcacgacgaggaguucugcgacauguggcgccucuucgacuucaacaagcaggcgauccagcggcugaaggccgaggcccagaugaacauccagcugaucaacaaggccgucaacgcccucaucaacgaccagcugaugaugaagaaccaccuccgcgacaucauggggauccccuacugcaacuacagcaaguucugguaccugaacaacaccaccacgggccggaccucccugccccgcugcuggcugaucagcaacggcuccuaccucaacgagacccacuucagcgacgacaucgagcagcaggcggacaacaugaucaccgagaugcugcagaaggaguacauggaccggcaggggaagacgccccugggccucguggaccuguucguguucuccaccagcuucuaccugaucaccaucuuccuccaccuggucaagaucccgacccaccgccacaucguggggaagcccugccccaagccccaccggcugaaccacaugggcaucugcuccugcgggcuguacaagcagccgggcgugcccguccgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5540 - RNA, 1855 nt, Artificial Sequence
  mRNA product Design2 comprising derived and/or modified sequence from Lassa virus__CAA36645__GPC (opt1) R6028/R6633
ggggcgcugccuacggagguggcagccaucuccuucucggcaucaagcuuaccaugggccagaucgugaccuucuuccaggaggucccccacgugaucgaggaggugaugaacaucguccugaucgcccucagcauccuggccauccugaaggggcucuacaacguggcgaccugcggccugaucgggcuggugacguuccuccugcuguccggccgcagcugcucccucaucuacaaggggaccuacgagcugcagacccuggagcucaacauggagacccugaacaugacgaugccgcugagcugcaccaagaacaacucccaccacuacauccgggucggcaacgagaccggccucgagcugacccugacgaacaccagcauccucaaccacaaguucugcaaccuguccgacgcccacaagcgcaaccuguacgaccacagccucauguccaucaucagcaccuuccaccuguccauccccaacuucaaccaguacgaggccaugagcugcgacuucaacgggggcaagaucaccgugcaguacaaccugucccacagcuucgccguggacgccgcggggcacugcggcacgcucgccaacgggguccugcagaccuucaugcggauggccuggggcggcuccuacaucgcccuggacagcgggcgcggcaacugggacugcaucaugaccuccuaccaguaccucaucauccagaacaccacgugggacgaccacugccaguucagccggcccucccccaucggguaccugggccugcucagccagcgcacccgggacaucuacaucagccgccggcugcugggcaccuucaccuggacgcucuccgacagcgaggggaacgagaccccgggcggguacugccugacccgcuggaugcugaucgaggcggagcucaagugcuucggcaacaccgccguggccaagugcaacgagaagcacgacgaggaguucugcgacaugcugcggcuguucgacuucaacaagcaggccauccgccggcucaagacggaggcccagauguccauccagcugaucaacaaggcggugaacgcccugaucaacgaccagcucaucaugaagaaccaccuccgcgacaucauggggauccccuacugcaacuacagccgguacugguaccugaaccacaccuccaccggcaagaccagccugccccgcugcuggcugaucuccaacggcagcuaccugaacgagacgaaguucuccgacgacaucgagcagcaggccgacaacaugaucaccgagaugcuccagaaggaguacaucgaccggcaggggaagacgccccugggccuggucgaccuguucguguucagcaccuccuucuaccucaucagcaucuuccugcaccuggugaagaucccgacccaccgccacaucgucgggaagcccugccccaagccccaccggcucaaccacaugggcaucugcuccugcgggcuguacaagcagccgggcgugcccgugcgcuggaagcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5541 - RNA, 1858 nt, Artificial Sequence; identical to SEQ ID NO: 5361
  mRNA product Design2 comprising derived and/or modified sequence from Lassa virus__NP_694870__GPC (opt1) R6023/R6630

SEQ ID NO: 5542 - RNA, 2095 nt, Artificial Sequence
  mRNA product Design2 comprising derived and/or modified sequence from Lassa virus__AAA46284__NP (opt1)
ggggcgcugccuacggagguggcagccaucuccuucucggcaucaagcuuaccaugagcgccuccaaggaggugcgcagcugccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagaagcgggacgacggcgaccugaagcgccugcgggaccucaaccaggccgugaacaaccugguggagcugaaguccacccagcagaaguccguccuccgcguggggacgcugagcuccgacgaccugcucauccuggccgccgaccuggagaagcucaagagcaaggugacccggaccgagcgcccccuguccagcggcgucuacauggggaaccuguccagccagcagcucgaccagcggcgcgcccugcugaacaugaucggcaugaccggcguguccgggggcgggaagggcgcgagcaacgggaucgugcgggucugggacgugaagaacgccgagcuccugaacaaccaguucggcacgaugccgucccugacccucgccugccugaccaagcagggccagguggaccugaacgacgccguccaggcgcucaccgaccuggggcugaucuacacggccaaguaccccaacagcagcgaccucgaccgccugucccagagccaccccauccugaacaugaucgacaccaagaaguccagccucaacaucuccggcuacaacuucagccugggggccgccgugaaggccggcgcgugcaugcuggacggcgggaacaugcucgagaccaucaaggugagcccccagaccauggacggcauccucaagagcauccugaaggucaagaagucccuggggauguucgugagcgacacgccgggcgagcggaaccccuacgagaacauccuguacaagaucugccuguccggggacggcuggagcuacaucgccucccgcaccagcaucgugggccgggccugggagaacaccgucguggaccucgagcaggacaacaagccccagaagaucgggaacggcggguccaacaagagccugcaguccgccggcuucgccgcggggcugaucuacagccagcucaugacccugaaggacuucaagugcuucaaccugauccccaacgccaagacguggauggacaucgagggccgcccggaggaccccguggagaucgcccuguaccagcccuccagcggcugcuacguccacuucuuccgggagcccaccgaccucaagcaguucaagcaggacgccaaguacagccacgggcgcgacgugaccgaccuguucgccgcgcagccgggccugaccuccgccgucaucgaggcccucccccggaacauggugaucacgugccaggggagcgaggacauccgcaagcugcuggagucccagggccgccgggacaucaagcucaucgacaucacccugagcaaggccgacucccgcaaguucgagaacgccgugugggaccaguucaaggaccugugccacaugcacaccggggucgugguggagaagaagaagcggggcggcaaggaggagaucacgccccacugcgcgcucauggacugcaucauguucgacgccgccgucagcgggggccuggacgccaaggugcugcgcgugguccucccccgggacaugguguuccgcaccuccaccccgaaggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5543 - RNA, 2092 nt, Artificial Sequence
  mRNA product Design2 comprising derived and/or modified sequence from Lassa virus__AAF86704__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgaggugaacaacguccagcgccucaugcggaagcagaagcgcgacgacggcgaccugaagcggcugcgcgaccucaaccaggccgugaacaaccugguggagcugaaguccacccagcagaaguccauccuccgggucgggacgcugaccagcgacgaccugcucacccuggccgccgaccuggagaagcucaagagcaaggugauccgcaccgagcggccccuguccagcggcguguacauggggaaccuguccacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccugggccucaucuacaccgcgaaguaccccaacuccagcgaccuggaccgccugucccagagccacccgauccucaacaugguggacaccaagaaguccagccugaacaucagcggguacaacuucucccugggcgccgccgugaaggccggggccugcaugcucgacggcggcaacaugcuggagacgaucaaggucacgccccagaccauggacgggauccucaagagcauccugaaggugaagcggucccugggcauguucgugagcgacacccccggggagcgcaaccccuacgagaacauccuguacaagaucugccucuccggcgacggguggccguacaucgcgagccggaccuccaucgucggccgcgccugggagaacaccaccguggaccuggagagcgacggcaagccccagaagguggggaccgccggcuccaacaagagccugcaguccgccggguuccccacgggccucaccuacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccacggaccugaagcaguucaagcaggacgccaaguacagccacggcaucgacguggccgaccuguucccggcccagcccgggcucaccuccgccgucaucgaggcgcugccccggaacauggugcugaccugccagggcagcgacgacaucaagaagcuccuggacucccaggggcgccgcgacaucaagcugaucgacaucagccucagcaagguggacucccggaaguucgagaacgccgucugggaccagugcaaggaccugugccacaugcacaccggcgugguggucgagaagaagaagcgcgggggcaaggaggagaucacgccccacugcgcccugauggacugcaucauguucgacgccgccgugagcggcgggcucaacaucccggugcugcgggcgguccugccccgcgacaugguguuccggaccuccagccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5544 - RNA, 2092 nt, Artificial Sequence
  mRNA product Design2 comprising derived and/or modified sequence from Lassa virus__AAO59513__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaaggagcgccgggacgacagcgaccugaagcgccugcgggaccucaaccaggccgugaacaaccugguggagcugaaguccacccagcagaaguccguccuccgcgugggcacccugaccagcgacgaccugcucgugcuggccgccgaccuggagaagcuccggagcaaggucacccgcaccgagcggccccuguccgccgggguguacaugggcaaccugagcucccagcagcucgaccagcgccgggcgcugcugagcaugaucgggaugaacggcuccaaccagggcgcccgcgccgggcgggacggcgugguccgcgugugggacgugaagaacgccgagcuccugaacaaccaguucgggaccaugccgagccugacccucgcgugccugaccaagcagggccaggucgaccugaacgacgccgugcaggcccucaccgaccuggggcugaucuacacggccaaguaccccaacaccuccgaccucgaccggcugacccagagccaccccauccugaacaugaucgacaccaagaaguccagccucaacgugagcggcuacaacuucucccugggcgccgcggucaaggccggggccugcaugcuggacggcgggaacaugcucgagacgaucaaggugagcccccagaccauggacggcauccugaaguccauccugaaggugaagaaggcccucggcauguucaucagcgacaccccgggggagcgcaaccccuacgagaacauccuguacaagaucugccuguccggcgacggguggcccuacaucgccagccggaccuccaucacgggccgcgcgugggagaacaccgucguggaccucgagagcgacgagaagccccagaaggccggguccaacaacagcaacaagucccugcagagcgccggcuucaccgccggccugaccuacucccagcucaugacgcugaaggacgccaugcugcagcuggacccgaacgcgaagaccuggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacaucaccgaccuguucgccgcccagcccggccucacguccgcggucaucgacgcccugccccgcaacauggugaucacgugccaggggagcgacgacauccggaagcugcucgagagccagggccgcaaggacaucaagcugaucgacaucgcccugaacaaggccgacucccggaaguacgagaacgcggucugggaccaguacaaggaccucugccacaugcacaccggcgugguggucgagaagaagaagcgcgggggcaaggaggagaucacgccccacugcgcccugauggacugcaucauguucgacgccgccgugagcgggggccugaagacccucgugcugcgggccguccugccgcgcgacaugguguuccggaccuccacgccccgcgugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5545 - RNA, 2092 nt, Artificial Sequence
  mRNA product Design2 comprising derived and/or modified sequence from Lassa virus__AAT48999__NP (opt1)
ggggcgcugccuacggagguggcagccaucuccuucucggcaucaagcuuaccaugagcguguccaaggagaucaagagcuuccuguggacccagucccuccgccgggagcugagcggcuacugcuccaacaucaagcugcaggucgugaaggacgcccaggcccuccugcacgggcuggacuucagcgagguguccaacguccagcgccucaugcggaagcagcgccgggacgacaacgaccugaagcgccugcgggaccucaaccaggcggugaacaaccugguggagcucaagagcacccagcagaaguccguccugcgcgugggcacgcugaccagcgacgaccugcucauccuggccgccgaccuggagaagcucaaguccaaggugacccggaccgagcgcccccugagcgccggggucuacaugggcaaccuguccagccagcagcucgaccagcggcgcgcccugcugaacaugaucgggauguccggcggcaaccagggggcgcagacgggccgggacgggguggugcgcaucugggacgucaagaacgccgagcuccugaacaaccaguucggcaccaugccgagccugacccucgccugccugaccaagcagggccagguggaccugaacgacgugguccaggcccucacggaccuggggcugaucuacaccgcgaaguaccccaacaccuccgaccucgaccggcugacccagagccaccccauccugaacaugaucgacacgaagaaguccagccucaacaucagcggcuacaacuucucccugggggccgccgugaaggccggcgccugcaugcuggacgggggcaacaugcucgagaccaucaaggugagcccccagaccauggacggcauccugaaguccauccugaaggucaagaaggcgcucgggauguucaucagcgacaccccgggcgagcgcaaccccuacgagaacauccuguacaagaucugccuguccggggacggcuggcccuacaucgccagccggacguccaucaccgggcgcgccugggagaacaccgugguggaccucgagagcggcgagaagccccagaagaucggcuccaacaacagcaacaagugccugcaguccgccggguucaccgccggccugagcuacucccagcucaugacgcugaaggacgcgaugcugcagcuggacccgaacgccaagaccuggauggacaucgaggggcggcccgaggaccccgucgagaucgcccucuaccagcccagcuccggcugcuacauccacuucuuccgcgagccgaccgaccugaagcaguucaagcaggacgccaaguacagccacgggaucgacgugaccgaccuguucgccgcgcagcccggccucacguccgccgugaucgaggcccugccccggaacauggucaugaccugccagggcagcgacgacauccgcaagcugcucgagucccaggggcgcaaggacaucaagcugaucgacaucgcccugagcaagaccgacagccggaaguacgagaacgccgugugggaccaguacaaggaccucugccacaugcacaccggcgucgugguggagaagaagaagaagggcgggaaggaggagaucacgccccacugcgcgcugauggacugcaucauguucgacgccgccgucuccgggggccugaacaccagcgugcuccgcgccgugcugccgcgggacauggucuuccgcaccuccacccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5546 - RNA, 2092 nt, Artificial Sequence
  mRNA product Design2 comprising derived and/or modified sequence from Lassa virus__AAT49007__NP (opt1)
ggggcgcugccuacggagguggcagccaucuccuucucggcaucaagcuuaccaugagcguguccaaggagaucaagagcuuccuguggacccagucccuccgccgggagcugagcggcuacugcuccaacaucaagcugcaggucgugaaggacgcccaggcccuccugcacgggcuggacuucagcgagguguccaacguccagcgccucaugcggaagcagcgccgggacgacaacgaccugaagcgccugcgggaccucaaccaggcggugaacaaccugguggagcucaagagcacccagcagaaguccguccugcgcgugggcacgcugaccagcgacgaccugcucauccuggccgccgaccuggagaagcucaaguccaaggugacccggaccgagcgcccccugagcgccgggaucuacaugggcaaccuguccagccagcagcucgaccagcggcgcgcccugcugaacaugaucgggauguccggcggcaaccagggggcgcagacgggccgggacggggucgugcgcaucugggacgugaagaacgccgagcuccugaacaaccaguucggcaccaugccgagccugacccucgccugccugaccaagcaggggcaggucgaccugaacgacguggugcaggcccucacggaccugggccugaucuacaccgcgaaguaccccaacaccuccgaccucgaccggcugacccagagccaccccauccugaacaugaucgacacgaagaaguccagccucaacaucagcggcuacaacuucucccugggggccgccgucaaggccggcgccugcaugcuggacgggggcaacaugcucgagaccaucaaggugagcccccagaccauggacggcauccugaaguccauccugaaggugaagaaggcgcucgggauguucaucagcgacaccccgggcgagcgcaaccccuacgagaacauccuguacaagaucugccuguccggggacggcuggcccuacaucgccagccggacguccaucaccgggcgcgccugggagaacaccgucguggaccucgagagcggcgagaagccccagaagaucggcuccaacaacagcaacaagucccugcagagcgccggguucaccgccggccugacguacucccagcucaugacccugaaggacgcgaugcugcagcuggacccgaacgccaagaccuggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacgucacggaccuguucgccgcgcagcccggccucaccuccgccgugaucgaggcccugccccggaacauggugaugaccugccagggcagcgacgacauccgcaagcugcucgagucccaggggcgcaaggacaucaagcugaucgacaucgcccugagcaagaccgacagccggaaguacgagaacgccgucugggaccaguacaaggaccucugccacaugcacacgggcguggucguggagaagaagaagaagggcgggaaggaggagaucacgccccacugcgcgcugauggacugcaucauguucgacgccgccgccuccgggggccugaacacccucgugcugcgcgcgguccugccgcgggacaugguguuccgcaccagcacccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5547 - RNA, 2092 nt, Artificial Sequence
  mRNA product Design2 comprising derived and/or modified sequence from Lassa virus__AAT49009__NP (opt1)
ggggcgcugccuacggagguggcagccaucuccuucucggcaucaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaaguccguccugcgcguggggacccugaacagcgacgaccugcucgugcuggccgccgaccuggagaagcucaaguccaaggucauccggaccgagcgcccccugagcuccggcaucuacauggggaaccugagcucccagcagcucgaccagcggcgcgcccugcugaacaugaucggcaugaccggcgggaaccggggcgggggcaccagcuccgacgggaucgugcgcgugugggacgucaagaacgcggagcuccugaacaaccaguucggcacgaugccgagccugacccucgccugccugaccaagcagggccagguggaccugaacgacgccgugcaggcccucaccgaccuggggcugaucuacacggcgaaguaccccaacuccagcgaccucgaccggcuggcccagagccaccccauccugaacaugaucgacaccaagaaguccagccucaacaucuccggcuacaacuucagccugggggccgccgucaaggccggcgcgugcaugcuggacggcgggaacaugcucgagaccaucaaggugagcccccagaccaucgacggcauccugaagacgauccugaaggugaagaagucccucgggauguucaucagcgacgucccgggcgagcgcaaccccuacgagaacauccuguacaagaucugccugagcggggacggcuggcccuacaucgccucccggaccagcaucgugggccgcgccugggagaacaccguggucgaccucgaguccgacaacaagccccagaagaccgggaacggcgggagcaacaagucccugcagagcgccggcuucgccgcggggcugacguacucccagcucaugacccugaaggacagcaugcugcagcuggacccgaacuccaagaccuggauggacaucgagggccggcccgaggaccccguggagaucgcccucuaccagcccaacagcggcugcuacauccacuucuuccgcgagccgaccgaccugaagcaguucaagcaggacgccaaguacucccacgggaucgacgugacggaccuguucgccgcccagcccggccucaccagcgcggucaucgaggcccugccccggaacauggugaucacgugccaggggagcgaggacauccgcaagcugcucgagucccagggccgccgggacaucaagcugaucgacaucagccugaacaaggccgacucccgcaaguucgagaacgccgucugggaccaguucaaggaccucugccacaugcacaccggggugguggucgagaagaagaagcggggcggcaaggaggagaucacgccccacugcgcccugauggacugcaucauguucgacgcggccgugagcgggggccuggacgccaaggugcuccgcgccguccugccgcgggacaugguguuccgcaccuccacccccaaggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5548 - RNA, 2092 nt, Artificial Sequence
  mRNA product Design2 comprising derived and/or modified sequence from Lassa virus__ADI39452__NP (opt1)
ggggcgcugccuacggagguggcagccaucuccuucucggcaucaagcuuaccaugagcguguccaaggaggucaagagcuuccuguggacccagucccuccgccgggagcugagcggcuacugcuccaacaucaagcuccagguggugaaggacgcccaggcccugcugcacgggcuggacuucagcgaggucuccaacgugcagcgccucaugcggaagcagcgccgggacgacaacgaccugaagcgccugcgggaccucaaccaggcggugaacaaccuggucgagcucaagagcacccagcagaaguccgugcugcgcgugggcacccugaccagcgacgaccugcucauccuggccgccgaccuggagaagcucaagaccaaggucacccggacggagcgcccccuguccgccgggguguacaugggcaaccugagcucccagcagcucgagcagcggcgcgcccugcugaacaugaucgggaugaacggcggcaaccagggggugcaggcgggccgggacggggucgugcgcgugugggacgucaagaacgccgagcuccugaacaaccaguucggcaccaugccgagccugacccucgccugccugaccaagcagggccagguggaccugaacgacgccgugcaggcgcucacggaccuggggcugaucuacaccgccaaguaccccaacaccuccgaccucgaccggcuggcccagagccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccugaaguccauccugaaggugaagcgcacccucgggauguucgucagcgacaccccgggcgagcggaaccccuacgagaacauccuguacaagaucugccuguccggggacggcuggcccuacaucgccagccgcacguccaucaccgggcgggccugggagaacaccaucguggaccucgagagcgacggcaagccccagaaggugggcaacaacggguccaacaagagccugcaguccgccggcuucaccgcggggcugacguacagccagcucaugacccugaaggacgccaugcugcagcuggacccgaacgccaagaccuggauggacaucgagggccgccccgaggaccccgucgagguggcccucuaccagcccuccagcgggugcuacauccacuucuuccgggagccgaccgaccugaagcaguucaagcaggacgccaaguacucccacggcaucgacgucacggaccuguucgcggcccagcccggccucaccagcgccgugaucgaggcccugccccgcaacauggugaucacgugccagggguccgaggacguccgcaagcugcucgagagccagggccggaaggacaucaagcugaucgacaucgcccuguccaaggcggacagccgcaaguacgagaacgccgugugggaccaguacaaggaccucugccacaugcacaccgggguggucguggagaagaagaagcggggcgggaaggaggagaugacgccccacugcgcccugauggacugcaucauguucgacgccgcgguguccggcggccugagcacccagguccuccgcgccgugcugccgcgggacaugguguuccgcaccagcacccccaaggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5549 - RNA, 2092 nt, Artificial Sequence
  mRNA product Design2 comprising derived and/or modified sequence from Lassa virus__ADU56611__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugaccagcgacgaccugcucacccuggccgccgaccuggagaagcucaaguccaaggugauccgcaccgagcggccccugagcuccggcgucuacauggggaaccugagcacgcagcagcucgagcagcgcaaggcccugcuguccaugaucggcauggugggcggggcgcagggcacccagccggggcgggacggcgugguccgcgugugggacgugaagaaccccgaccuccugaacaaccaguucgggaccaugcccagccugacccucgccugccugacgaagcagggccaggucgaccugaacgacgccgugcucgcccugaccgaccugggccucaucuacaccgcgaaguaccccaacuccagcgaccuggaccggcugucccagagccacccgauccucaacaugguggacaccaagaaguccagccugaacaucagcggguacaacuucucccugggcgccgccgucaaggccggggccugcaugcucgacggcggcaacaugcuggagacgaucaaggugacgccccagaccauggacgggauccucaagagcauccugaaggugaagcgcucccugggcauguucgucagcgacacccccggggagcggaaccccuacgagaacauccuguacaagaucugccucuccggcgacggguggccguacaucgcgagccgcaccuccaucgugggccgggccugggagaacaccaccguggaccuggagagcgacggcaagccccagaaggucgggaccgccggcuccaacaagagccugcaguccgccggguuccccacgggccucaccuacagccagcugaugacccugaaggacuccaugaugcagcuggaccccagcgccaagaccuggaucgacaucgaggggcgcccggaggaccccguggagaucgcgcucuaccagcccauguccggcugcuacauccacuucuuccgggagcccacggaccugaagcaguucaagcaggacgccaaguacagccacggcaucgacgucaccgaccuguucuccgcccagccggggcucaccagcgccgugaucgaggcccugccccgcaacauggugcugaccugccagggcagcgacgacaucaagaagcuccuggacucccaggggcggcgcgacaucaagcugaucgacaucagccucaacaaggcggacucccgccgguucgagaacgccgucugggaccagugcaaggaccugugccacaugcacacgggcgugguggucgagaagaagaagcgcgggggcaaggaggagaucacgccccacugcgcccugauggacugcaucauguucgacgccgccgugagcggcgggcucaacauccccauccugcgggcggugcugccgcgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5550 - RNA, 2092 nt, Artificial Sequence
  mRNA product Design2 comprising derived and/or modified sequence from Lassa virus__ADU56615__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccggaucggcacccugagcagcgacgaccugcucauccuggccgccgaccuggagaagcucaaguccaagguggugcgcaccgagcggccccugagcuccgggaucuacaugggcaaccugagcucccagcagcucgaccagcgcaaggcccugcugaacaugaucgggaugaccggcggcaacgggggccggaacgcgaccagcgacgggaucguccgcgugugggacgugaagaacgccgagcuccugaacaaccaguucggcacgaugccgucccugacccucgccugccugaccaagcaggggcaggucgaccugaacgacgccgugcaggcgcucaccgaccugggccugaucuacacggccaaguaccccaacagcagcgaccucgaccggcuggcccagucccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagaccauggacggcauccugaaguccauccugaaggugaagcgcagccucgggauguucaucuccgacacgccgggcgagcggaaccccuacgagaacauccuguacaagaucugccugagcggggacggcuggcccuacaucgccucccgcaccagcaucguggggcgggccugggagaacaccgucguggaccucgagaccgacaacaagccccagaagacgggcaacggcggguccaacaagagccugcaguccgccggcuucgcggccgggcugaccuacagccagcucaugacccugaaggacuccaugcugcagcuggacccgaacgccaagaccuggauggacaucgagggccgccccgaggaccccguggagaucgcccucuaccagcccgucagcgggugcuacauccacuucuuccgggagccgacggaccugaagcaguucaagcaggacgccaaguacucccacggcaucgacgugaccgaccuguucgcggcccagcccggccucaccagcgccgugaucgaggcccugccccgcaacauggucaucacgugccaggggagcgaggacauccggaagcugcucgagucccagggccgccgcgacaucaagcugaucgacaucagccuguccaagguggacagccggaaguucgagaacgccgucugggaccaguucaaggaccucugccacaugcacaccgggaucgugguggagaagaagaagcgcggcgggaaggaggagaucacgccccacugcgcgcugauggacugcaucauguucgacgccgccgucuccggcggcguggacgccaaggugcugcgggcgguccucccgcgcgacaugguguuccggaccagcacccccaaggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5551 - RNA, 2092 nt, Artificial Sequence
  mRNA product Design2 comprising derived and/or modified sequence from Lassa virus__ADU56619__NP (opt1)
ggggcgcugccuacggagguggcagccaucuccuucucggcaucaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugagcuccgacgaccugcucgugcuggccgccgaccuggagaagcucaagagcaaggucgugcgcaccgagcggccccuguccagcggcaucuacauggggaaccuguccagccagcagcucgaccagcgcaaggcccugcugaacaugaucggcaugaccggcgggaacggcgggcggaacaccacguccgacggcaucgugcgcgucugggacgugaagaacgcggagcuccugaacaaccaguucgggaccaugccgagccugacccucgccugccugaccaagcagggccagguggaccugaacgacgccguccaggcccucacggaccugggccugaucuacaccgcgaaguaccccaacuccagcgaccucgaccggcuggcccagagccaccccauccugaacaugaucgacaccaagaaguccagccucaacaucuccggguacaacuucagccugggcgccgccgugaaggccggggcgugcaugcuggacggcggcaacaugcucgagaccaucaaggugagcccccagacgauggacgggauccucaagagcauccugaaggucaagcgcucccugggcauguucaucagcgacaccccgggggagcggaaccccuacgagaacauccuguacaagaucugccuguccggcgacggguggcccuacaucgccagccgcaccuccaucgugggccgggccugggagaacaccguggucgaccucgagagcgacaacaagccccagaagacgggcaacgggggcuccaacaagagccugcaguccgccggguucgccgcgggccugaccuacagccagcucaugacccugaaggacuccaugcugcagcuggacccgaacgccaagaccuggauggacaucgaggggcgccccgaggaccccguggagaucgcccucuaccagcccagcuccggcugcuacauccacuucuuccgggagccgacggaccugaagcaguucaagcaggacgccaaguacagccacggcaucgacgugaccgaccuguucgccgcgcagcccgggcucaccagcgccgucaucgaggcccugccccgcaacauggugaucacgugccagggcuccgaggacauccggaagcugcucgagagccaggggcgccgcgacaucaagcugaucgacaucucccugagcaaggucgacucccggaaguucgagaacgccgugugggaccaguucaaggaccucugccacaugcacaccggcaucguggucgagaagaagaagcgcgggggcaaggaggagaucacgccccacugcgcccugauggacugcaucauguucgacgcggccgugagcggcgggguggacgccaagguccugcgggccgugcucccgcgcgacaugguguuccggaccuccacccccaaggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5552 - RNA, 2092 nt, Artificial Sequence
  mRNA product Design2 comprising derived and/or modified sequence from Lassa virus__ADU56623__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccgucgagaucgcgcuguaccagcccauguccgggugcuacauccacuucuuccgggagcccacggaccugaagcaguucaagcaggacgccaaguacagccacggcaucgacguggccgaccucuucccggcccagcccggccugaccuccgccgucaucgaggcgcugccccgcaacauggugcugaccugccaggggagcgacgacaucaagcggcuccuggacagccagggccgccgcgacaucaagcucaucgacaucgcccuguccaaggccgacagccggcgcuucgagaacgccgugugggaccagugcaaggaccugugccacaugcacaccggggucgugguggagaagaagaagcggggcgggaaggaggagaucacgccccacugcgcccucauggacugcaucauguacgacgcggccgucuccggcggccugaacaucccggugcugcgcgccgugcucccccgggacauggucuuccgcaccagcucccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5553 - RNA, 2092 nt, Artificial Sequence
  mRNA product Design2 comprising derived and/or modified sequence from Lassa virus__ADU56627__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccugaacacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagucccacccgauccucaacauggucgacaccaagaaguccagccugaacaucagcggcuacaacuucagccugggggccgccgugaaggccggcgcgugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggccugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgcgaagaccuggaucgacaucgagggccgcccggaggaccccguggagaucgcccucuaccagcccaugagcgggugcuacauccacuucuuccgggagcccacggaccugaagcaguucaagcaggacgccaaguacucccacggcaucgacgucgccgaccuguucccggcccagcccggccucaccagcgcggugaucgaggcccugccccgcaacaugguccugaccugccagggguccgacgacaucaagcggcuccuggacagccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5554 - RNA, 2092 nt, Artificial Sequence
  mRNA product Design2 comprising derived and/or modified sequence from Lassa virus__ADU56631__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacgugaccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaacaucccggugcugcgcgccgugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5555 - RNA, 2092 nt, Artificial Sequence
  mRNA product Design2 comprising derived and/or modified sequence from Lassa virus__AFY05580__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccggcggcaagccccagaaggccgacagcaacaacuccagcaagucccugcagagcgccggguucaccgccggccugaccuacucccagcucaugacccugaaggacgccaugcugcagcuggacccgaacgcgaagacguggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacgugaccgaccuguucgccacccagcccggccucacguccgccgucaucgacgcgcugccccgcaacauggugaucacgugccagggcagcgacgacauccggaagcugcucgagagccaggggcgcaaggacaucaagcugaucgacaucgaccuguccaagaccgacagccggaaguacgagaacgccgugugggaccaguacaaggaccucugccacaugcacaccggcgucguggucgagaagaagaagcgcgggggcaaggaggagaucaccccgcacugcgcccugauggacugcaucauguucgacgccgcgguguccgggggccugaacaccagcgugcuccgggccguccugccccgcgacaugguguuccggaccuccacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5556 - RNA, 2092 nt, Artificial Sequence
  mRNA product Design2 comprising derived and/or modified sequence from Lassa virus__AFY05581__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccggcggcaagccccagaaggccgacagcaacaacuccagcaagucccugcagagcgccggguucaccgccggccugaccuacucccagcucaugacccugaaggacgccaugcugcagcuggacccgaacgcgaagacguggauggacaucgaggggcgccccgaggaccccguggagaucgcccucuaccagcccagcuccggcugcuacauccacuucuuccgggagccgaccgaccugaagcaguucaagcaggacgccaaguacagccacgggaucgacgugaccgaccuguucgccacccagcccggccucacguccgccgucaucgacgcgcugccccgcaacauggugaucacgugccagggcagcgacgacauccgcaagcugcucgagagccaggggcggaaggacaucaagcugaucgacaucgaccuguccaagaccgacagccgcaaguacgagaacgccgugugggaccaguacaaggaccucugccacaugcacaccggcgucguggucgagaagaagaagcgcgggggcaaggaggagaucaccccgcacugcgcccugauggacugcaucauguucgacgccgcgguguccgggggccugaacaccagcgugcucaaggccguccugccccgggacaugguguuccggaccuccacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5557 - RNA, 2092 nt, Artificial Sequence
  mRNA product Design2 comprising derived and/or modified sequence from Lassa virus__AFY05587__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5558 - RNA, 2092 nt, Artificial Sequence
  mRNA product Design2 comprising derived and/or modified sequence from Lassa virus__AFY05591__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgucgagcuccugagcaaccaguucggcaccaugccgucccugacgcucgccugccugaccaagcagggccagguggaccugaacgacgcggugcaggcccucaccgaccuggggcugaucuacaccgccaaguaccccaacacgagcgaccucgaccgccuggcccagucccaccccauccugaacaugaucgacaccaagaaguccagccucaacaucuccggcuacaacuucagccugggggccgcggucaaggccggcgccugcaugcuggacgggggcaacaugcucgagaccaucaaggugagcccccagaccauggacggcauccucaagagcauccugaaggugaagaaggcccuggggauguucaucuccgacacgccgggcgagcggaaccccuacgagaacauccuguacaagaucugccugagcggggacggcuggcccuacaucgccucccgcaccagcaucaccgggcgggcgugggagaacaccgucguggaccucgaguccgacggcaagccccagaaggccgacagcaacaacuccagcaagucccugcagagcgccggcuucacggccgggcugaccuacucccagcucaugacccugaaggacgccaugcugcagcuggacccgaacgcgaagaccuggauggacaucgagggccgccccgaggaccccguggagaucgcccucuaccagcccagcuccgggugcuacauccacuucuuccgggagccgacggaccugaagcaguucaagcaggacgccaaguacagccacggcaucgacgucaccgaccuguucgccacccagcccgggcucaccuccgccgugaucgacgcgcugccccgcaacauggugaucacgugccagggcagcgacgacauccgcaagcugcucgagagccagggccggaaggacaucaagcugaucgacaucgaccuguccaagaccgacagccgcaaguacgagaacgccgucugggaccaguacaaggaccucugccacaugcacaccgggguggucguggagaagaagaagcggggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5559 - RNA, 2092 nt, Artificial Sequence
  mRNA product Design2 comprising derived and/or modified sequence from Lassa virus__AFY05597__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccgcaagcugcucgagagccagggccggaaggacaucaagcugaucgacaucgaccuguccaagaccgacagccgcaaguacgagaacgccgugugggaccaguacaaggaccucugccacaugcacaccggggucguggucgagaagaagaagcggggcgggaaggaggagaucaccccgcacugcgcccugauggacugcaucauguucgacgccgcgguguccggcgggcugaacaccagcgugcuccgcgccguccugccccgggacaugguguuccgcaccuccacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5560 - RNA, 2092 nt, Artificial Sequence
  mRNA product Design2 comprising derived and/or modified sequence from Lassa virus__AFY05610__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacgcugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacacgaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgugaccgaccuguucgccacgcagcccgggcucaccuccgccgucaucgacgcccugccccgcaacauggugaucacgugccagggcagcgacgacauccgcaagcugcucgagagccagggccggaaggacaucaagcugaucgacaucgaccuguccaagaccgacagccgcaaguacgagaacgcggugugggaccaguacaaggaccucugccacaugcacaccggggucguggucgagaagaagaagcggggcgggaaggaggagaucaccccgcacugcgcccugauggacugcaucauguucgacgccgccguguccggcgggcugaacaccagcgugcuccgcgcgguccugccccgggacaugguguuccgcaccuccacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5561 - RNA, 2092 nt, Artificial Sequence
  mRNA product Design2 comprising derived and/or modified sequence from Lassa virus__AFY05616__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccuggcccagucccaccccauccugaacaugaucgacaccaagaaguccagccucaacaucuccggcuacaacuucagccugggggcggccgugaaggccggcgccugcaugcuggacgggggcaacaugcucgagaccaucaaggucagcccccagaccauggacggcauccucaagagcauccugaaggugaagaaggcccuggggauguucaucuccgacacgccgggcgagcggaaccccuacgagaacauccuguacaagaucugccugagcggggacggcuggcccuacaucgcgucccgcaccagcaucaccgggcgggccugggagaacaccguggucgaccucgaguccgacggcaagccccagaaggccgacagcaacaacuccagcaagucccugcagagcgccggcuucacggccgggcugaccuacucccagcucaugacccugaaggacgcgaugcugcagcuggacccgaacgccaagaccuggauggacaucgagggccgccccgaggaccccguggagaucgcccucuaccagcccagcuccgggugcuacauccacuucuuccgggagccgacggaccugaagcaguucaagcaggacgccaaguacagccacggcaucgacgugaccgaccuguucgccacccagcccgggcucaccuccgcggucaucgacgcccugccccgcaacauggugaucacgugccagggcagcgacgacauccgcaagcugcucgagagccagggccggaaggacaucaagcugaucgacaucgaccuguccaagaccgacagccgcaaguacgagaacgccgugugggaccaguacaaggaccucugccacaugcacaccggggucguggucgagaagaagaagcggggcgggaaggaggagaucacgccccacugcgcccugauggacugcaucauguucgacgcggccguguccggcgggcugaacaccagcgugcuccgcgccguccugccgcgggacaugguguuccgcaccuccacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5562 - RNA, 2098 nt, Artificial Sequence
  mRNA product Design2 comprising derived and/or modified sequence from Lassa virus__AFY05618__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcagaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5563 - RNA, 2092 nt, Artificial Sequence
  mRNA product Design2 comprising derived and/or modified sequence from Lassa virus__AHC95552__NP (opt1)
ggggcgcugccuacggagguggcagccaucuccuucucggcaucaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacccugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcaugacgggcgggaaccagggcacccaggcggggcgggacggcguggugcgcgucugggacgugaagaacgccgagcuccugaacaaccaguucgggaccaugccgucccugacccucgccugccugacgaagcagggccaggccgaccugaacgacgugguccaggcgcucaccgaccugggccugaucuacaccgccaaguaccccaacgccagcgaccucgaccggcugacccagucccaccccauccugaacaugaucgacacgaagaaguccagccucaacaucagcggguacaacuucagccugggcgccgccgugaaggcgggggccugcaugcuggacggcggcaacaugcucgagaccaucaaggugagcccccagagcauggacgggauccugaaguccauccugaaggucaagcgcgcccucggcauguucgugagcgacaccccgggggagcggaaccccuacgagaacauccuguacaagaucugccuguccggcgacggguggcccuacaucgccagccgcaccuccaucgugggccgggccugggagaacacggucguggaccucgaggcggacggcaaccccaagaagcugaacagcaacggguccaacaagagccugcaguccgccggcuucccggccgggcucaccuacagccagcugaugacccugaaggacgccaugcugcagcucgaccccaacgccaagaccuggauggacaucgagggccgccccgaggaccccguggaggucgcgcuguaccagccgaacuccgggugcuacauccacuucuuccgggagcccacggaccugaagcaguucaagcaggacgccaaguacagccacggcaucgacgugaccgaccucuucgccgcccagcccggccugaccuccgccgucaucgaggcgcugccccgcaacauggugaucacgugccaggggagcgaggacauccgcaagcuccuggagucccagggccggaaggacaucaagcugaucgacaucgcccucagcaagaccgacucccgcaaguucgagaacgccgugugggaccaguacaaggaccugugccacaugcacaccggggucgugguggagaagaagaagcggggcgggaaggaggagaucaccccgcacugcgcccugauggacugcaucauguucgacgcggccgucagcggcggccucaacacccuggugcugcgcgccgugcucccccgggacauggucuuccgcacgagcacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5564 - RNA, 2092 nt, Artificial Sequence
  mRNA product Design2 comprising derived and/or modified sequence from Lassa virus__AHC95554__NP (opt1)
ggggcgcugccuacggagguggcagccaucuccuucucggcaucaagcuuaccaugagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagcggcgcgacgacggcgaccugaagcggcugcgcgaccucaaccaggccgugaacaaccugguggagcucaagagcacccagcagaaguccguccugcggguggggacccugaacagcgacgaccugcucacccuggccgccgaccuggagaagcucaaguccaaggugacccgcaccgagcggccccugagcuccggcgucuacauggggaaccugagcucccagcagcucgaccagcgccgggcccugcugaacaugaucggcaugacgggcgggaaccagggcgcgcaggccgggcgcgacggcguggugcgggucugggacgugaagaacgccgagcuccugaacaaccaguucgggaccaugccgagccugacccucgccugccugaccaagcagggccagguggaccugaacgacgucgugcaggcgcucacggaccugggccugaucuacaccgccaaguaccccaacaccuccgaccucgaccgccugacccagagccaccccauccugaacaugaucgacacgaagaaguccagccucaacaucagcggguacaacuucucccugggcgccgccgugaaggccggggcgugcaugcuggacggcggcaacaugcucgagaccaucaagaucagcccccaguccgucgacgggauccucaagagcauccugaaggugaagcggucccugggcauguucgugagcgacaccccgggggagcgcaaccccuacgagaacauccuguacaagaucugccuguccggcgacggguggcccuacaucgccagccggaccuccaucgucggccgcgccugggagaacacggugguggaccucgaggccgacggcaagccccagaagccgaacagcggguccagcaacaagucccugcagagcgccggcuuccccgcggggcugaccuacucccagcucaugacccugaaggacgccaugcugcagcuggaccccaacgccaagaccuggauggacaucgagggccggcccgaggacccggucgagguggcccucuaccagcccagcuccgggugcuacauccacuucuuccgcgagcccacggaccugaagcaguucaagcaggacgccaaguacagccacggcaucgacgucaccgaccuguucgcggcccagcccggccucaccuccgccgugaucgaggcccugccgcgcaacauggugaucacgugccaggggagcgaggacaucaagaagcugcucgagagccagggccggaaggacaucaagcugaucgacaucgcccuguccaagaucgacagccgcaaguucgagaacgcggucugggaccaguacaaggaccucugccacaugcacaccggggugguggucgagaagaagaagcggggcgggaaggaggagaucacgccccacugcgcccugauggacugcaucauguucgacgccgccguguccggcggccugaacgcgagcgugcuccgcgccguccugccccgggacaugguguuccgcaccuccacccccaaggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5565 - RNA, 2092 nt, Artificial Sequence
  mRNA product Design2 comprising derived and/or modified sequence from Lassa virus__AHC95556__NP (opt1)
ggggcgcugccuacggagguggcagccaucuccuucucggcaucaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacgcugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcaugacgggcgggaaccagggcacccagaccgggcgggacggcguggugcgcgucugggacgugaagaacgcggagcuccugaacaaccaguucgggaccaugccgucccugacgcucgccugccugaccaagcagggccaggccgaccugaacgacgugguccaggcccucaccgaccugggccugaucuacaccgcgaaguaccccaacgccagcgaccucgaccggcugacgcagucccaccccauccugaacaugaucgacaccaagaaguccagccucaacaucagcggguacaacuucagccugggcgccgccgugaaggccggggcgugcaugcuggacggcggcaacaugcucgagaccaucaaggugagcccccagagcauggacgggauccugaaguccauccugaaggucaagcgcgcccucggcauguucgugagcgacaccccgggggagcggaaccccuacgagaacauccuguacaagaucugccuguccggcgacggguggcccuacaucgccagccgcacguccaucgugggccgggccugggagaacaccgucguggaccucgaggccgacggcaaccccaagaagcugaacagcaacggguccaacaagagccugcaguccgcgggcuucccggccgggcucaccuacagccagcugaugacccugaaggacgccaugcugcagcucgaccccaacgccaagacguggauggacaucgagggccgccccgaggaccccguggaggucgcccuguaccagccgaacuccgggugcuacauccacuucuuccgggagcccaccgaccugaagcaguucaagcaggacgcgaaguacagccacggcaucgacgugaccgaccucuucgccgcccagcccggccugaccuccgccgucaucgaggcccugccccgcaacauggugaucacgugccaggggagcgaggacauccgcaagcuccuggagucccagggccggaaggacaucaagcugaucgacaucgcgcucagcaagaccgacucccgcaaguucgagaacgccgugugggaccagcacaaggaccugugccacaugcacaccggggucgugguggagaagaagaagcggggcgggaaggaggagaucaccccgcacugcgcccugauggacugcaucauguucgacgccgcggucagcggcggccucaacacgcuggugcugcgcgccgugcucccccgggacauggucuuccgcaccagcacccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5566 - RNA, 2092 nt, Artificial Sequence
  mRNA product Design2 comprising derived and/or modified sequence from Lassa virus__AHC95558__NP (opt1)
ggggcgcugccuacggagguggcagccaucuccuucucggcaucaagcuuaccaugagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagcggcgcgacgacagcgaccugaagcggcugcgcgaccucaaccaggccgugaacaaccugguggagcugaaguccacccagcagaaguccguccuccgggugggcacgcuguccagcgacgaccugcucacccuggccgccgaccuggagaagcucaaguccaaggugauccgcaccgagcggccccugagcuccggggucuacaugggcaaccugagcucccagcagcucgaccagcgccgggcccugcugaacaugaucgggaugaccggcggcaaccagggggcgcaggccggccgcgacgggguggugcgggucugggacgugcgcaacgccgagcuccugaacaaccaguucggcacgaugccgagccugacccucgccugccugaccaagcagggccagguggaccugaacgacgucgugcaggcgcucaccgaccuggggcugaucuacacggccaaguaccccaacaccuccgaccucgaccggcugacccagaaccaccccauccugaacaugaucgacaccaagaaguccagccucaacaucagcggcuacaacuucagccugggggccgccgugaaggccggcgcgugcaugcuggacgggggcaacaugcucgagacgaucaaggucagcccccagagcaucgacggcauccugaaguccauccugaaggugaagcgcacccucgggauguucgugagcgacaccccgggcgagcggaaccccuacgagaacauccuguacaagaucugccuguccggggacggcuggcccuacaucgccagccgcaccuccaucgucgggcgggccugggagaacacggugguggaccucgagaccgaccgcaagagccagggccccaacuccggcaacagcaacaagucccugcagagcgccggguucuccgccggccugaccuacagccagcucaugacccugaaggacgcgaugcugcagcuggacccgaacgccaagacguggauggacaucgaggggcgccccgaggaccccgucgagguggcccucuaccagcccaucuccggcugcuacauccacuucuuccgggagccgaccgaccugaagcaguucaagcaggacgccaaguacagccacgggaucgacaucaccgaccuguucgccgcgcagcccggccucaccuccgccgucaucgaggcccugccccgcaacauggugaucacgugccagggcagcgaggacaucaagaagcugcucgagagccaggggcggaaggacaucaagcugaucgacaucgcccuguccaagaucgacagccgcaaguucgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaacgccagcgugcuccgggcggugcugccgcgggacauggucuuccgcaccuccacccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5567 - RNA, 2092 nt, Artificial Sequence
  mRNA product Design2 comprising derived and/or modified sequence from Lassa virus__AHC95560__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacgcugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcauguccggcgggaaccagggcacccagguggggcgggacggcgugguccgcgugugggacgugaagaacgcggagcuccugaacaaccaguucgggaccaugccgagccugacccucgccugccugaccaagcagggccaggccgaccugaacgacgucgugcaggcccucacggaccugggccugaucuacaccgcgaaguaccccaacgccuccgaccucgaccggcugacccagagccaccccauccugaacaugaucgacaccaagaaguccagccucaacaucagcggguacaacuucucccugggcgccgccgugaaggccggggcgugcaugcuggacggcggcaacaugcucgagacgaucaaggucagcccccaguccauggacgggauccucaagagcauccugaaggugaagcgcgcccugggcauguucguguccgacaccccgggggagcggaaccccuacgagaacauccuguacaagaucugccugagcggcgacggguggcccuacaucgccucccgcaccagcaucgucggccgggccugggagaacaccgugguggaccucgaggccgacggcaaccccaagaagcugaacuccaacgggagcaacaagucccugcagagcgcgggcuucccggccgggcucacguacucccagcugaugacccugaaggacgccaugcugcagcucgaccccaacgccaagaccuggauggacaucgagggccgccccgaggaccccgucgagguggcccuguaccagccgaacagcgggugcuacauccacuucuuccgggagcccaccgaccugaagcaguucaagcaggacgcgaaguacucccacggcaucgacgucacggaccucuucgccgcccagcccggccugaccagcgccgugaucgaggcccugccccgcaacauggugaucacgugccagggguccgaggacauccgcaagcuccuggagagccagggccggaaggacaucaagcugaucgacaucgcgcucuccaagaccgacagccgcaaguucgagaacgccgucugggaccagcacaaggaccugugccacaugcacacgggggugguggucgagaagaagaagcggggcgggaaggaggagaucaccccgcacugcgcccugauggacugcaucauguucgacgccgcggugagcggcggccucaacacccuggugcugcgcgccguccucccccgggacaugguguuccgcaccuccacgcccaaggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5568 - RNA, 2092 nt, Artificial Sequence
  mRNA product Design2 comprising derived and/or modified sequence from Lassa virus__AIT17127__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcaaccagggggugcgggccggcaaggacggggucgugcgcgugugggacgucaagaacgccgagcuccugaacaaccaguucggcaccaugccgucccugacgcucgccugccugaccaagcagggccagguggaccugaacgacgcggugcaggcccucaccgaccuggggcugaucuacaccgccaaguaccccaacacgagcgaccucgaccggcugacccagucccaccccauccugaacaugaucgacaccaagaaguccagccucaacaucuccggcuacaacuucagccugggggccgccgucaaggcgggcgccugcaugcuggacgggggcaacaugcucgagaccaucaaggugagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgccugggagaacacggucguggaccucgaguccgacggcaagccccagaaggcgggcagcaacaacuccaacaagagccugcaguccgccggguucaccgccggccugaccuacagccagcucaugacccugaaggacgccaugcugcagcuggacccgaacacgaagaccuggauggacaucgaggggcggcccgaggaccccguggagaucgcccucuaccagcccuccagcggcugcuacauccacuucuuccgcgagccgaccgaccugaagcaguucaagcaggacgcgaaguacucccacgggaucgacgucaccgaccuguucgccgcccagcccggccucacgagcgccgugaucgacgcccugccccggaacauggugaucacgugccagggcuccgacgacauccgcaagcugcucgagagccaggggcgcaaggacaucaagcugaucgacaucgcgcugaacaagaccgacagccggaaguacgagaacgccgucugggaccaguacaaggaccucugccacaugcacaccggcguggucguggagaagaagaagcgcgggggcaaggaggagaucaccccgcacugcgcccugauggacugcaucauguucgacgccgcgguguccgggggccugaacaccagcguccuccgggccgugcugccccgcgacaugguguuccggaccuccacgccccgcgucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5569 - RNA, 2092 nt, Artificial Sequence
  mRNA product Design2 comprising derived and/or modified sequence from Lassa virus__AIT17131__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacgcugagcuccgacgaccugcucguccuggccgccgaccuggagaagcucaagagcaaggugacccggaccgagcgcccccuguccgccgggguguacaugggcaaccugagcucccagcagcucgaccagcggcgcgcgcugcugaacaugaucgggaugagcggcggcaaccagggggcccgggccggccgcgacggggucgugcgggugugggacgucaagaacgccgagcuccugaacaaccaguucggcaccaugccgucccugacgcucgcgugccugaccaagcagggccagguggaccugaacgacgugguccaggcccucaccgaccuggggcugaucuacaccgccaaguaccccaacacgagcgaccucgaccgccugacccagucccaccccauccugaacaugguggacaccaagaaguccagccucaacaucuccggcuacaacuucagccugggggccgccgugaaggcgggcgccugcaugcuggacgggggcaacaugcucgagaccaucaaggucagcccccagacgaucgacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggccugggagaacacgguggucgaccucgaguccgacggcaagccccagaaggcgggcagcaacaacuccaacaagagccugcaguccgccggguucaccgccggccugaccuacagccagcucaugacccugaaggacgccaugcugcagcuggacccgaacgccaagaucuggauggacaucgaggggcgccccgaggaccccguggagaucgcgcucuaccagcccuccagcggcugcuacauccacuucuuccgggagccgacggaccugaagcaguucaagcaggacgccaaguacucccacgggaucgacgugaccgaccuguucgccgcccagcccggccucaccagcgccgucaucgacgcgcugccccgcaacauggugaucacgugccagggcgccgacgacauccgcaagcugcucgagucccaggggcggaaggacaucaagcugaucgacaucgcccugaacaaggccgacagccgcaaguacgagaacgcggucugggaccaguacaaggaccucugccacaugcacaccggcgugguggucgagaagaagaagcgcgggggcaaggaggagaucaccccgcacugcgcccugauggacugcaucauguucgacgccgccgugagcgggggccugaacaccuccgugcuccgggccguccugccccgggacaugguguuccgcaccagcacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5570 - RNA, 2092 nt, Artificial Sequence
  mRNA product Design2 comprising derived and/or modified sequence from Lassa virus__AIT17139__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggaucguggucgagaagaagaagcggggcgggaaggaggagaucacgccccacugcgcccugauggacugcaucauguucgacgccgccgugagcggcgggcugaacaccuccgugcuccgcgccguccugccgcgggacaugguguuccgcaccaccacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5571 - RNA, 2092 nt, Artificial Sequence
  mRNA product Design2 comprising derived and/or modified sequence from Lassa virus__AIT17143__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcaacaacggcagcaacaagucccugcagagcgccggguucaccgccggccugaccuacucccagcucaugacgcugaaggacgccaugcugcagcuggacccgaacgcgaagaccuggauggacaucgaggggcgccccgaggaccccguggagaucgcccucuaccagcccagcuccggcugcuacauccacuucuuccgggagccgaccgaccugaagcaguucaagcaggacgccaaguacagccacgggaucgacgugaccgaccuguucgccgcccagcccggccucacguccgcggucaucgacgcccugccccgcaaccuggugaucacgugccagggcagcgacgacauccgcaagcuccuggagucccaggggcggaaggacaucaagcugaucgacaucgcccucagcaagaccgacagccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucuccgggggccucaacaccagcgugcugcgggccgugcugccccgggacauggucuuccgcaccuccacgccccggguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5572 - RNA, 2092 nt, Artificial Sequence
  mRNA product Design2 comprising derived and/or modified sequence from Lassa virus__AIT17147__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgagcagcggcgcgcgcugcugaacaugaucgggauguccggcagcaaccagggcgcccaggccgggcgggacggcgucgugcgcgugugggacgucaagaacgccgagcuccugaacaaccaguucgggacgaugccgucccugacccucgcgugccugaccaagcagggccagguggaccugaacgacgccgugcaggcccucaccgaccuggggcugaucuacacggucaaguaccccaacaccagcgaccucgaccggcugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgacaccccgggggagcgcaaccccuacgagaacauccuguacaagaucugccugagcggcgacggguggcccuacaucgccucccggaccagcaucacgggccgcgccugggagaacaccgugguggaccucgaguccgacgggaagccccagaaggcggacagcaacuccagcaacaagucccugcagagcgccggcuucaccgccggccugaccuacucccagcucaugacgcugaaggacgccaugcugcagcuggacccgaacgccaagaccuggauggacaucgaggggcggcccgaggaccccgucgagguggcgcucuaccagcccagcuccggcugcuacauccacuucuuccgcgagccgaccgaccugaagcaguucaagcaggacgccaaguacagccacgggaucgacgugaccgaccuguucgccgcccagcccggccucacguccgccgucaucgacgcgcugccccggaacauggugaucacgugccaggggagcgacgacauccgcaagcugcucgagagccagggccgcaaggacaucaagcugaucgacaucgcccuguccaagaccgacagccggaaguacgagaacgccgucugggaccaguacaaggaccucugccacaugcacaccggcgugguggucgagaagaagaagcgcgggggcaaggaggagaucaccccgcacugcgcccugauggacugcaucauguucgacgcggccguguccgggggccugaacaccagcgugcuccgggccguccugccccgcgacaugguguuccggaccuccacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5573 - RNA, 2092 nt, Artificial Sequence
  mRNA product Design2 comprising derived and/or modified sequence from Lassa virus__AIT17151__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacguggugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagcugcagaaggcgggcagcaacaacuccaacaagagccugcaguccgccggguucaccgccggccucaccuacagccagcugaugacgcugaaggacgccaugcugcagcucgaccccaacgccaagaccuggauggacaucgaggggcgcccggaggaccccguggagaucgcgcuguaccagcccuccagcggcugcuacauccacuucuuccgggagcccaccgaccugaagcaguucaagcaggacgccaaguacucccacgggaucgacgucaccgaccucuucgccgcccagccgggccugacgagcgccgugaucgacgcgcugccccgcaacauggugaucacgugccagggcuccgacgacauccgcaagcuccuggagagccaggggcggaaggacaucaagcugaucgacaucgcccucaacaagaccgacagccgcaaguacgagaacgccgucugggaccaguacaaggaccugugccacaugcacaccggcguggucguggagaagaagaagaagggcgggaaggaggagaucacgccccacugcgcccugauggacugcaucauguucgacgcggccguguccgggggccucaacaccagcguccugcgggccgugcugccccgcgacaugguguuccggaccuccaccccgcgcgucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5574 - RNA, 2092 nt, Artificial Sequence
  mRNA product Design2 comprising derived and/or modified sequence from Lassa virus__AIT17155__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgagcugcucgugcuggccgccgaccuggagaagcucaaguccaaggugauccggaccgagcgcccccugagcgccggggucuacaugggcaaccuguccagccagcagcucgaccagcggcgcgcgcugcuguccaugaucgggaugagcggcggcaaccagggggcccggaccggccgcgacgggguggugcgggucugggacgugaagaacgccgagcuccugaacaaccaguucggcaccaugccgucccugacccucgccugccugaccaagcagggccagguggaccugaacgacgcgguccaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggggccgccgugaaggcgggcgccugcaugcuggacgggggcaacaugcucgagacgaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgugguggaccucgaguccgacggcaagccccagaaggcgggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccgucgagaucgcgcucuaccagcccuccagcggcugcuacauccacuucuuccgggagccgaccgaccugaagcaguucaagcaggacgccaaguacucccacgggaucgacgugaccgaccuguucgccgcccagcccggccucacgagcgccgugaucgacgcgcugccccgcaacauggucaucacgugccagggcuccgacgacauccgcaagcugcucgagagccaggggcggaaggacaucaagcugaucgacaucgcccugagcaagaucgacucccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgcggccgucagcgggggccugaacucccucgugcugcgggccgugcugccgcgggacauggucuuccgcaccagcacgccccggguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5575 - RNA, 2092 nt, Artificial Sequence
  mRNA product Design2 comprising derived and/or modified sequence from Lassa virus__AIT17161__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggaccgggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccguggucgaccucgaguccgacgggaagccccagaaggcgggcagcaacuccagcaacaagucccugcagagcgccggccugaccgccgggcucacguacucccagcugaugacccugaaggacgccaugcugcagcucgacccgaacgccaagaccuggauggacaucgagggccgccccgaggaccccguggagaucgcgcuguaccagcccagcuccgggugcuacauccacuucuuccgggagccgaccgaccugaagcaguucaagcaggacgccaaguacagccacggcaucgacgugacggaccucuucgccgcccagcccgggcugaccuccgccgucaucgacgcgcugccccgcaaccucgugaucacgugccagggcagcgacgacauccgcaagcugcuggagagccagggccggaaggacaucaagcucaucgacaucgcccuguccaagaccgacagccgcaaguacgagaacgccgugugggaccaguacaaggaccugugccacaugcacaccgggaucgucguggagaagaagaagcggggcgggaaggaggagaucacgccccacugcgcccucauggacugcaucauguucgacgcggccgucuccggcgggcugaacgccagcgugcugcgcgccgugcucccgcgggacauggucuuccgcaccuccacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5576 - RNA, 2092 nt, Artificial Sequence
  mRNA product Design2 comprising derived and/or modified sequence from Lassa virus__AIT17165__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgaggugaacaacgugcagcgccucaugcggaaggagcgccgggacgacaacgaccugaagcgccugcgggaccucaaccaggccgucaacaaccugguggagcugaaguccacccagcagaaguccauccuccgcgugggcacccugaccuccgacgaccugcucauccuggccgccgaccuggagaagcucaagagcaaggucacccggaccgagcgcccccuguccgccgggguguacaugggcaaccugagcucccagcagcucgaccagcggcgcgcgcugcugaacaugaucgggaugagcaacggcaaccagggcacgcgggccgggcgcgacggcgugguccgggugugggacgugaagaacgccgagcuccugaacaaccaguucgggaccaugccgucccugacccucgccugccugaccaagcagggccaggucgaccugaacgacguggugcaggcgcucacggaccuggggcugaucuacaccgccaaguaccccaacaccagcgaccucgaccgccugacccagucccaccccauccugaacaugaucgacacgaagaaguccagccucaacaucagcggcuacaacuucagccugggcgccgccgucaaggccggggcgugcaugcuggacggcgggaacaugcucgagaccaucaaggugagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccgucguggaccucgaguccgacgggaagccccagaaggccgacagcuccaacagcaacaagucccugcagagcgcgggcuucaccgccggccugacguacucccagcucaugacccugaaggacgccaugcugcagcuggacccgaacgccaagaccuggauggacaucgaggggcgccccgaggaccccguggaggucgcccucuaccagcccagcuccggcugcuacauccacuucuuccgggagccgaccgaccugaagcaguucaagcaggacgcgaaguacagccacgggaucgacgugacggaccuguucgccgcccagcccggccucaccuccgccgugaucgacgcccugccccgcaacauggucaucacgugccaggggagcgacgacauccgcaagcugcucgagucccagggccggaaggacaucaagcugaucgacaucgcgcugagcaaggccgacagccgcaaguacgagaacgccgugugggaccagcacaaggaccucugccacaugcacaccggcgucgugguggagaagaagaagcgcgggggcaaggaggagaucaccccgcacugcgcccugauggacugcaucauguacgacgcggccgucuccgggggccugaacaccagcgugcuccgggccgugcugccccgggacauggucuuccgcaccuccacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5577 - RNA, 2092 nt, Artificial Sequence
  mRNA product Design2 comprising derived and/or modified sequence from Lassa virus__AIT17169__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcuccggcaaccagcgggcccaggccggccgcgacggggugguccgggugugggacgugaagaacgucgagcuccugaacaaccaguucggcaccaugccgagccugacgcucgccugccugaccaagcagggccagguggaccugaacgacgcggugcaggcccucaccgaccuggggcugaucuacaccgccaaguaccccaacacguccgaccucgaccgccugacccagagccaccccauccugaacaugaucgacaccaagaaguccagccucaacaucagcggguacaacuucucccugggcgccgccgucaaggcgggcgccugcaugcuggacgggggcaacaugcucgagaccaucaaggugagcccccagacgauggacgggauccugaaguccauccugaaggugaagaaggcccucggcauguucaucagcgacaccccgggcgagcggaaccccuacgagaacauccuguacaagaucugccuguccggggacggcuggcccuacaucgccagccgcaccuccaucaccgggcgggccugggagaacacggucguggaccucgagagcgacggcaagccccagaaggcgggguccaacaacagcaacaagucccugcagagcgugggcuucaccgccggccugaccuacucccagcucaugacccugaaggacgccaugcugcagcuggacccgaacgccaagacguggauggacaucgaggggcgccccgaggaccccgucgagaucgcccucuaccagcccagcuccggcugcuacauccacuucuuccgggagccgaccgaccugaagcaguucaagcaggacgcgaaguacagccacgggaucgacgugaccgaccuguucgccgcccagcccggccucaccuccgccgugaucgacgcccugccccgcaacauggucaucacgugccaggggagcgacgacauccgcaagcugcucgagagccagggccggaaggacaucaagcugaucgacaucgcgcuguccaagaccgacagccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgccgcggucuccgggggccugaacaccagcgugcuccgggccgugcugccgcgggacauggucuuccgcaccuccacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5578 - RNA, 2092 nt, Artificial Sequence
  mRNA product Design2 comprising derived and/or modified sequence from Lassa virus__AIT17173__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgggacauggucuuccgcaccagcacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5579 - RNA, 2092 nt, Artificial Sequence
  mRNA product Design2 comprising derived and/or modified sequence from Lassa virus__AIT17177__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucgugcuggccgccgaccuggagaagcucaaguccaaggugauccggaccgagcgcccccugagcgccgggaucuacaugggcaaccuguccagccagcagcucgaccagcggcgcgcgcugcugaacaugaucgggauguccggcggcaaccagggggcccgggccggccgcgacggggucgugcgggugugggacgucaagaacgccgaccuccugaacaaccaguucggcaccaugccgagccugacgcucgcgugccugaccaagcagggccagguggaccugaacgacgugguccaggcccucaccgaccuggggcugaucuacaccgccaaguaccccaacacguccgaccucgaccgccugacccagagccaccccauccugaagaugaucgacgccaacaaguccagccucaacaucagcggcuacaacuucucccugggggccgcggugaaggccggcgccugcaugcuggacgggggcaacaugcucgagaccaucaaggugagcccccagaccauggacggcauccugaaguccauccugaaggucaagaagucccucgggauguucaucagcgacacgccgggcgagcggaaccccuacgagaacauccuguacaagaucugccugagcggggacggcuggcccuacaucgccucccgcaccagcaucaucgggcgggccugggagaacaccgugguggaccucgaguccgacggcaagccccagaagaccggcagcaacaacuccagcaagucccugcagagcgcgggguucgccgccggccugacguacucccagcucaugacccugaaggacgccaugcugcagcuggacccgaacgccaagaccuggauggacaucgaggggcgccccgaggaccccgucgagaucgcgcucuaccagcccagcuccggcugcuacauccacuucuuccgggagccgaccgaccugaagcaguucaagcaggacgccaaguacagccacgggaucgacgugacggaccuguucgccgcccagcccggccucaccuccgccgugaucgaggcgcugccccgcaacauggucaucacgugccagggcagcgacgacauccgcaagcugcucgagagccaggggcggaaggacaucaagcugaucgacaucgcccuguccaagaccgacagccgcaaguacgagaacgccgugugggaccaguacaaggaccucugccacaugcacaccggcaucgucguggagaagaagaagcgcgggggcaaggaggagaucacgccccacugcgcccugauggacugcaucauguucgacgcggccguguccgggggccugaacacccucguccugcgggccgugcugccgcgggacaugguguuccgcaccagcacccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5580 - RNA, 2092 nt, Artificial Sequence
  mRNA product Design2 comprising derived and/or modified sequence from Lassa virus__AIT17181__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacaacgaccugaagcgccugcgggaccucaaccaggccgugaacaaccugguggagcucaagagcacccagcagaaguccguccugcgcgugggcacccugaccagcgacgaccugcucgugcuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcauccaggggacccggacgggccgcgacggggugguccgggugugggacgugaagaacgccgaccuccugaacaaccaguucggcaccaugccgagccugacccucgccugccugaccaagcaggggcaggucgaccugaacgacguggugcaggcccucacggaccugggccugaucuacaccgcgaaguaccccaacgccuccgaccucgaccgccugacccagagccaccccauccugaacaugaucgacaccaagaaguccagccucaacaucagcggcuacaacuucucccugggggccgccgucaaggccggcgcgugcaugcuggacgggggcaacaugcucgagacgaucaaggugagcccccagaccauggacggcauccugaaguccauccugaaggugaagaagacccucgggauguucaucagcgacaccccgggcgagcggaaccccuacgagaacauccuguacaagaucugccuguccggggacggcuggcccuacaucgccagccgcacguccaucaccgggcgggccugggagaacaccgucguggaccucgagagcgacggcaagccccagaaggccggcuccaacaacagcaacaagucccugcagagcgccggguucgcggccggccugaccuacucccagcucaugacgcugaaggacgccaugcugcagcuggacccgaacgccaagaccuggauggacaucgaggggcgccccgaggaccccguggagaucgcccucuaccagcccagcuccggcugcuacauccacuucuuccgggagccgaccgaccugaagcaguucaagcaggacgcgaaguacagccacgggaucgacgucaccgaccuguucgccgcccagcccggccucacguccgccgugaucgaggcccugccccgcaacauggucaucacgugccagggcagcgacgacaucaagaagcugcucgagucccaggggcgcaaggacaucaagcugaucgacaucgcgcugagcaagaccgacagccggaaguacgagaacgccgugugggaccaguacaaggaccucugccacaugcacaccggcguggucguggagaagaagaagcgcgggggcaaggaggagaucaccccgcacugcgcccugauggacugcaucauguucgacgccgcgguguccgggggccugaacacccucguccugcgggccgugcugccccgcgacaugguguuccggaccagcacgccccgcgucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5581 - RNA, 2092 nt, Artificial Sequence
  mRNA product Design2 comprising derived and/or modified sequence from Lassa virus__AIT17185__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcucaagagcacccagcagaaguccgugcugcgcgucgggacccugaccagcgacgaccugcucauccuggccgccgaccuggagaagcucaaguccaaggugacccggaccgagcgcccccugagcgccggcguguacauggggaaccuguccagccagcagcucgaccagcggcgcgcgcugcugaacaugaucggcauguccggcgggaaccggggcgcccgcacggggaaggacggcgucgugcggaucugggacgugaagaacgccgaccuccugaacaaccaguucgggaccaugccgagccugacccucgccugccugaccaagcagggccaggucgaccugaacgacguggugcaggcgcucacggaccugggccugaucuacaccgccaaguaccccaacaccuccgaccucgaccgccugacccagagccaccccauccugaacaugaucgacacgaacaaguccagccucaacaucagcggguacaacuucucccugggcgccgccgucaaggccggggcgugcaugcuggacggcggcaacaugcucgagaccaucaaggugagcccccagaccauggacgggauccugaaguccauccugaaggugaagaagucccucggcauguucaucagcgacaccccgggggagcggaaccccuacgagaacauccuguacaagaucugccugagcggcgacggguggcccuacaucgccucccgcacgagcaucaccggccgggccugggagaacaccgucguggaccucgaguccgacgagaagccccagaaggccggcagcaacaacuccaacaagagccugcaguccaccggguucacggccggccugaccuacagccagcucaugacccugaaggacgcgaugcugcagcuggacccgaacgccaagaccuggauggacaucgaggggcgccccgaggaccccguggagaucgcccucuaccagcccuccagcggcugcuacauccacuucuuccgggagccgacggaccugaagcaguucaagcaggacgccaaguacucccacgggaucgacgucaccgaccuguucgccgcgcagcccggccucaccagcgccgugaucgacacccugccccgcaacauggugaucacgugccagggcuccgacgacauccgcaagcugcucgagagccaggggcggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucacgccccacugcgcccugauggacugcaucauguucgacgcggccgugagcgggggccugaacgccuccguccuccgggccgugcugccgcgggacaugguguuccgcaccagcacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5582 - RNA, 2092 nt, Artificial Sequence
  mRNA product Design2 comprising derived and/or modified sequence from Lassa virus__AIT17189__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggaccggccgcgacggggucgugcgggugugggacgucaagaacgccgagcuccugaacaaccaguucggcaccaugccgucccugacccucgccugccugaccaagcagggccagguggaccugaacgacgugguccaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggugagcccccagaccaucgacggcauccucaagagcauccugaaggucaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgugguggaccucgaguccgacggcaagccccagaaggccggcagcaacaacuccaacaagagccugcaguccgcgggguucaccgccggccugacguacagccagcucaugacccugaaggacgccaugcugcagcuggacccgaacgccaagaccuggauggacaucgaggggcgccccgaggaccccgucgagaucgcccucuaccagcccuccagcggcugcuacauccacuucuuccgggagccgaccgaccugaagcaguucaagcaggacgcgaaguacucccacgggaucgacgugacggaccuguucgccgcccagcccggccucaccagcgccgugaucgacgcccugccccgcaacauggucaucacgugccagggcuccgacgacauccgcaagcugcucgagagccaggggcggaaggacaucaagcugaucgacaucgcgcugagcaagaccgacucccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgccgcggucagcgggggccugaacucccucgugcugcgggccgugcugccgcgggacauggucuuccgcaccagcacgccccggguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5583 - RNA, 2092 nt, Artificial Sequence
  mRNA product Design2 comprising derived and/or modified sequence from Lassa virus__AIT17193__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggaccggccgcgacggggucgugcgggugugggacgucaagaacgccgagcuccugaacaaccaguucggcaccaugccgucccugacccucgccugccugaccaagcagggccagguggaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgucaaggcgggcgccugcaugcuggacgggggcaacaugcucgagaccaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgucguggaccucgaguccgacggcaagccccagaaggcgggcaacaacaacagcaacaagucccugcagagcgccggguucaccgccggccugacguacucccagcucaugacccugaaggacgccaugcugcagcuggacccgaacgccaagaccuggauggacaucgaggggcgccccgaggaccccguggagaucgcgcucuaccagcccagcuccggcugcuacauccacuucuuccgggagccgaccgaccugaagcaguucaagcaggacgccaaguacagccacgggaucgacgucacggaccuguucgccgcccagcccggccucaccuccgccgugaucgacgcgcugccccgcaacauggugaucacgugccagggcagcgacgacauccgcaagcugcucgagucccaggggcggaaggacaucaagcugaucgacaucgcccugagcaagaccgacagccgcaaguacgagaacgccgucugggaccaguacaaggaccucugccacaugcacaccggcguggucguggagaagaagaagcgcgggggcaaggaggagaucacgccccacugcgcccugauggacugcaucauguucgacgcggccguguccgggggccugaacagccucguccugcgggccgugcugccgcgggacaugguguuccgcaccuccacgccccgggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5584 - RNA, 2092 nt, Artificial Sequence
  mRNA product Design2 comprising derived and/or modified sequence from Lassa virus__AIT17197__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccugucccuccagcagcuggaccagcggcgcgcgcugcucaacaugaucgggaugagcggcuccaaccagggcgugcgggccgggcgcgacggcgucgugcgggugugggacgucaagaacgccgagcugcugaacaaccaguucgggaccaugccgagccucacgcuggccugccugaccaagcagggccagguggaccucaacgacgcggugcaggcccugaccgaccuggggcucaucuacaccgccaaguaccccaacacguccgaccuggaccgccugacccagagccaccccauccucaacaugaucgacaccaagaaguccagccugaacaucagcggcuacaacuucucccugggcgccgccgucaaggcgggggccugcaugcucgacggcgggaacaugcuggagaccaucaaggugagcccccagacgauggacggcauccugaaguccauccucaaggugaagaaggcccugggcauguucaucagcgacaccccgggggagcggaaccccuacgagaacauccuguacaagaucugccucuccggcgacggguggcccuacaucgccagccgcaccuccaucaccggccgggccugggagaacacggucguggaccuggagagcgacgggaagccccagaaggcgggcuccaacggcagcaacaagucccugcagagcgccggguucaccgccggccucaccuacucccagcugaugacccugaaggacgccaugcugcagcucgacccgaacgccaagacguggauggacaucgaggggcgccccgaggaccccguggagaucgcgcuguaccagcccagcuccggcugcuacauccacuucuuccgggagccgaccgaccugaagcaguucaagcaggacgccaaguacagccacgggaucgacgucaccgaccucuucgccgcccagcccggccugaccuccgccgugaucgacgcgcugccccgcaacauggugaucacgugccagggcagcgacgacauccgcaagcuccuggagucccaggggcggaaggacaucaagcugaucgacaucgcccucagcaagaccgacagccgcaaguacgagaacgccgucugggaccaguacaaggaccugugccacaugcacaccggcaucguggucgagaagaagaagcgcgggggcaaggaggagaucacgccccacugcgcccugauggacugcaucauguucgacgcggccguguccgggggccucaacaccagcgugcugcgggccguccugccgcgggacaugguguuccgcaccuccacgccccgggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5585 - RNA, 2092 nt, Artificial Sequence
  mRNA product Design2 comprising derived and/or modified sequence from Lassa virus__AIT17201__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacaucaagaagcuguucgagagccaggggcgcaaggacaucaagcucaucgacaucgcccugagcaagaccgacucccggaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgcgacauggucuuccggaccagcacgccccgcguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5586 - RNA, 2092 nt, Artificial Sequence
  mRNA product Design2 comprising derived and/or modified sequence from Lassa virus__AIT17205__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggaaggcgcugcugaacaugaucgggauguccggcagcaaccagggcgcccgcaucgggcgggacggcgugguccgcgugugggacgugaagaacgccgagcuccugaacaaccaguucgggacgaugccgucccugacccucgccugccugaccaagcagggccaggucgaccugaacgacgcggugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggucagcccccagaccauggacggcauccucaagagcauccugaaggugaagaaggcccugggcauguucaucuccgacaccccgggggagcgcaaccccuacgagaacauccuguacaagaucugccugagcggcgacggguggcccuacaucgccucccggaccagcaucacgggccgcgccugggagaacaccguggucgaccucgaguccgacgggaagccccagaaggcgggcagcaacuccagcaacaagucccugcagagcgccggccugaccgccgggcucaccuacucccagcugaugacgcugaaggacgccaugcugcagcucgacccgaacgccaagaccuggauggacaucgagggccggcccgaggaccccguggagaucgcgcuguaccagcccagcuccgggugcuacauccacuucuuccgcgagccgaccgaccugaagcaguucaagcaggacgccaaguacagccacggcaucgacgugaccgaccucuucgccgcccagcccgggcugacguccgccgucaucgacgcgcugccccggaaccucgugaucacgugccagggcagcgacgacauccgcaagcugcuggagagccagggccgcaaggacaucaagcucaucgacaucgcccuguccaagaccgacagccggaaguacgagaacgccgugugggaccaguacaaggaccugugccacaugcacaccgggaucgucguggagaagaagaagcgcggcgggaaggaggagaucaccccgcacugcgcccucauggacugcaucauguucgacgcggccgucuccggcgggcugaacgccagcgugcugcgggccgugcucccccgcgacauggucuuccggaccuccacgccccgcguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5587 - RNA, 2092 nt, Artificial Sequence
  mRNA product Design2 comprising derived and/or modified sequence from Lassa virus__AIT17209__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacguggugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagcugcagaagaccggcagcaacaacuccaacaagagccugcaguccgcgggguucaccgccggccucacguacagccagcugaugacccugaaggacgccaugcugcagcucgaccccaacgccaagaucuggauggacaucgaggggcgcccggaggaccccguggagaucgcccuguaccagcccuccagcggcugcuacauccacuucuuccgggagcccaccgaccugaagcaguucaagcaggacgcgaaguacucccacgggaucgacgucaccgaccucuucgccgcccagccgggccugacgagcgccgugaucgacgcccugccccgcaacauggugaucacgugccagggcuccgacgacauccgcaagcuccuggagagccaggggcggaaggacaucaagcugaucgacaucgcgcucaacaagaccgacagccgcaaguacgagaacgccgucugggaccaguacaaggaccugugccacaugcacaccggcguggucguggagaagaagaagaagggcgggaaggaggagaucacgccccacugcgcccugauggacugcaucauguucgacgccgcgguguccgggggccucaacaccagcguccugcgggccgugcugccccgcgacaugguguuccggaccuccaccccgcgcgucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5588 - RNA, 2092 nt, Artificial Sequence
  mRNA product Design2 comprising derived and/or modified sequence from Lassa virus__AIT17211__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccaggccggccgggacggggugguccgcgugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccggcugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaaguccauccugaaggugaagaaggcccucgggauguucaucagcgacaccccgggcgagcgcaaccccuacgagaacauccuguacaagaucugccuguccggggacggcuggcccuacaucgccagccggaccuccaucacggggcgcgcgugggagaacaccguggucgaccucgagagcgacggcaagccccagaaggccaacuccaacagcuccaacaagagccugcaguccgccggcuucaccgccgggcugaccuacagccagcucaugacgcugaaggacgccaugcugcagcuggacccgaacgcgaagaccuggauggacaucgagggccggcccgaggaccccguggagaucgcccucuaccagcccuccagcgggugcuacauccacuucuuccgcgagccgaccgaccugaagcaguucaagcaggacgccaaguacucccacggcaucgacgugaccgaccuguucgccgcccagcccgggcucacgagcgcggucaucgacgcccugccccggaacauggugaucacgugccagggcuccgacgacauccgcaagcugcucgagagccagggccgcaaggacaucaagcugaucgacaucgcccugagcaagaccgacucccggaaguacgagaacgccgugugggaccaguacaaggaccucugccacaugcacaccgggaucgucguggagaagaagaagcgcggcgggaaggaggagaucaccccgcacugcgcgcugauggacugcaucauguucgacgccgccgucagcggcgggcugaacaccuccgugcuccgggccgugcugccccgcgacauggucuuccggaccagcacgccccgcguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5589 - RNA, 2092 nt, Artificial Sequence
  mRNA product Design2 comprising derived and/or modified sequence from Lassa virus__AIT17213__NP (opt1)
ggggcgcugccuacggagguggcagccaucuccuucucggcaucaagcuuaccaugagcgccuccaaggagaucaagagcuuccuguggacccagucccuccgccgggagcuggccggcuacugcagcaacaucaagcuccagguggucaaggacgcgcaggcccugcugcacgggcuggacuucuccgaggugagcaacgugcagcgccucaugcggaaggagcgccgggacgacaacgaccugaagcgccugcgggaccucaaccaggccgucaacaaccugguggagcugaaguccacccagcagaaguccgugcuccgcgucggcacccugaccagcgacgaccugcucauccuggccgccgaccuggagaagcucaagagcaaggugauccggaccgagcgcccccuguccgcggggguguacaugggcaaccugagcucccagcagcucgaccagcggcgcgcccugcugaacaugaucgggaugagcggcuccaaccagggcguccgggccgggcgcgacggcguggugcgggucugggacgugaagaacgccgagcuccugaacaaccaguucgggaccaugccgagccugacgcucgcgugccugaccaagcagggccagguggaccugaacgacgccguccaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggcgccgcggugaaggccggggccugcaugcuggacggcgggaacaugcucgagaccaucaaggugagcccccagacgauggacggcauccugaaguccauccugaaggucaagaaggcccucggcauguucaucagcgacaccccgggggagcggaaccccuacgagaacauccuguacaagaucugccuguccggcgacggguggcccuacaucgccagccgcaccuccaucaccggccgggcgugggagaacacggugguggaccucgagagcgacgggaagccccagaaggccggcuccaacggcagcaacaagucccugcagagcgccggguucaccgccggccugaccuacucccagcucaugacccugaaggacgccaugcugcagcuggacccgaacgcgaagacguggauggacaucgaggggcgccccgaggaccccgucgagaucgcccucuaccagcccagcuccggcugcuacauccacuucuuccgggagccgaccgaccugaagcaguucaagcaggacgccaaguacagccacgggaucgacgugaccgaccuguucgccgcccagcccggccucaccuccgcggugaucgacgcccugccccgcaacauggucaucacgugccagggcagcgacgacauccgcaagcugcucgagucccaggggcggaaggacaucaagcugaucgacaucgcccugagcaagaccgacagccgcaaguacgagaacgccgugugggaccaguacaaggaccucugccacaugcacaccggcaucgucguggagaagaagaagcgcgggggcaaggaggagaucacgccccacugcgcgcugauggacugcaucauguucgacgccgccguguccgggggccugaacaccagcguccuccgggccgugcugccgcgggacaugguguuccgcaccuccacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5590 - RNA, 2092 nt, Artificial Sequence
  mRNA product Design2 comprising derived and/or modified sequence from Lassa virus__AIT17217__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcuccggcgugcagggcgcccgggccgggcgcgacggcgucgugcgggugugggacgucaagaacgccgagcuccugaacaaccaguucgggacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggugagcccccagaccauggacggcauccugaaguccauccugaaggucaagaaggcccucggcauguucaucagcgagaccccgggggagcggaaccccuacgagaacauccuguacaagaucugccuguccggcgacggguggcccuacaucgccagccgcaccuccaucacgggccgggccugggagaacaccgugguggaccucgagagcgacgggaagccccagaaggcgggcuccaacaacagcaacaagucccugcagagcaccggcuucgccgccgggcugaccuacucccagcucaugacgcugaaggacgccaugcugcagcuggacccgaacgccaagaccuggauggacaucgagggccgccccgaggaccccgucgagguggcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgucaucgacgcgcugccccgcaacauggugaucacgugccagggcagcgacgacaucaagaagcugcucgagagccagggccgcaaggacaucaagcugaucgacaucgcccuguccaagaccgacagccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccguguccggcgggcugaacaccagcgugcuccgggccguccugccccgcgacaugguguuccggaccuccacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5591 - RNA, 2092 nt, Artificial Sequence
  mRNA product Design2 comprising derived and/or modified sequence from Lassa virus__AIT17225__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcugaacaugaucgggauguccggcggcaaccagggggcccgggccggcaacgacgggguggugcgcgucugggacgugaagaacgccgaccuccugaacaaccaguucggcacgaugccgagccugacccucgcgugccugaccaagcagggccagguggaccugaacgacgucgugcaggcccucaccgaccuggggcugaucuacacggccaaguaccccaacaccuccgaccucgaccggcugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggucagcccccagaccauggacggcauccugaaguccauccugaaggugaagaaggcccucgggauguucaucagcgacaccccgggcgagcgcaaccccuacgagaacauccuguacaagaucugccuguccggggacggcuggcccuacaucgccagccggaccuccaucacggggcgcgccugggagaacaccguggucgaccucgagagcgacggcaagccccagaagaccggcaacaacuccagcaacaagucccugcagagcgcgggguucaccgccggccugacguacucccagcucaugacccugaaggacgccaugcugcagcuggacccgaacgccaagaccuggauggacaucgaggggcggcccgaggaccccguggagguggcccucuaccagcccagcuccggcugcuacauccacuucuuccgcgagccgaccgaccugaagcaguucaagcaggacgcgaaguacagccacgggaucgacgucacggaccuguucgccgcccagcccggccucaccuccgccgugaucgaggcccugccccggaacauggucaucacgugccagggcagcgacgacauccgcaagcugcucgagucccaggggcgcaaggacaucaagcugaucgacaucgcgcugagcaagaucgacagccggaaguacgagaacgccgugugggaccaguacaaggaccucugccacaugcacaccggcguggucguggagaagaagaagcgcgggggcaaggaggagaucacgccccacugcgcccugauggacugcaucauguucgacgccgcgguguccgggggccugaacacccucguccugcgggccgugcugccgcgcgacaugguguuccggaccagcacccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5592 - RNA, 2092 nt, Artificial Sequence
  mRNA product Design2 comprising derived and/or modified sequence from Lassa virus__AIT17229__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcuguccaugaucgggaugagcggcggcaaccaggggacccgggccggccgcgacggggucgugcgggugugggacgucaagaacgccgagcuccugaacaaccaguucggcaccaugccgucccugacccucgccugccugaccaagcagggccagguggaccugaacgacgcggugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagccccagaaggcgggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccguggagaucgcgcucuaccagcccuccagcggcugcuacauccacuucuuccgggagccgaccgaccugaagcaguucaagcaggacgccaaguacucccacgggaucgacgucaccgaccuguucgccgcccagcccggccucacgagcgccgugaucgacgcgcugccccgcaacauggugaucacgugccagggcuccgacgacauccgcaagcugcucgagagccaggggcggaaggacaucaagcugaucgacaucgcccugagcaaggccgacucccgcaaguacgagaacgccgucugggaccaguacaaggaccucugccacaugcacaccggcguggucguggagaagaagaagcgcgggggcaaggaggagaucacgccccacugcgcgcugauggacugcaucauguucgacgccgccgugagcgggggccugaacaccuccguccuccgggccgugcugccgcgggacaugguguuccgcaccagcacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5593 - RNA, 2092 nt, Artificial Sequence
  mRNA product Design2 comprising derived and/or modified sequence from Lassa virus__AIT17233__NP (opt1)
ggggcgcugccuacggagguggcagccaucuccuucucggcaucaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaaggagcgccgggacgacaacgaccugaagcgccugcgggaccucaaccaggccgugaacaaccugguggagcucaagagcacccagcagaaguccauccugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagggggcccaggccggccgggacgggguggugcgcgucugggacgugaagaacgccgagcuccugaacaaccaguucggcacgaugccgucccugacccucgcgugccugaccaagcagggccagguggaccugaacgacgccguccaggcccucaccgaccuggggcugaucuacacggccaaguaccccaacaccagcgaccucgaccggcugacccagucccaccccauccugaacaugaucgacaccaagaaguccagccucaacaucagcggcuacaacuucagccugggggccgcggugaaggccggcgccugcaugcuggacgggggcaacaugcucgagacgaucaaggugagcccccagaccauggacggcauccucaagagcauccugaaggucaagaaggcccuggggauguucaucuccgacaccccgggcgagcgcaaccccuacgagaacauccuguacaagaucugccugagcggggacggcuggcccuacaucgccucccggaccagcaucacggggcgcgcgugggagaacaccgugguggaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcggcccgaggaccccgucgagguggcccucuaccagcccuccagcggcugcuacauccacuucuuccgcgagccgaccgaccugaagcaguucaagcaggacgccaaguacucccacgggaucgacgugaccgaccuguucgccgcccagcccggccucacgagcgcggucaucgacgcccugccccggaacauggugaucacgugccagggcuccgacgacauccgcaagcugcucgagagccaggggcgcaaggacaucaagcugaucgacaucgcccugagcaagaccgacucccggaaguacgagaacgccgucugggaccaguacaaggaccucugccacaugcacaccggcgugguggucgagaagaagaagcgcgggggcaaggaggagaucaccccgcacugcgcgcugauggacugcaucauguucgacgccgccgugagcgggggccugaacaccuccgugcuccgggccguccugccccgcgacaugguguuccggaccagcacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5594 - RNA, 2092 nt, Artificial Sequence
  mRNA product Design2 comprising derived and/or modified sequence from Lassa virus__AIT17237__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagacgaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagguggcccucuaccagcccuccagcggcugcuacauccacuucuuccgggagccgaccgaccugaagcaguucaagcaggacgccaaguacucccacgggaucgacgucaccgaccuguucgccgcccagcccggccucacgagcgcggugaucgacgcccugccccgcaacauggugaucacgugccagggcuccgacgacauccgcaagcugcucgagagccaggggcggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucaccccgcacugcgcgcugauggacugcaucauguucgacgccgccgugagcgggggccugaacaccuccguccuccgggccgugcugccccgggacaugguguuccgcaccagcacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5595 - RNA, 2092 nt, Artificial Sequence
  mRNA product Design2 comprising derived and/or modified sequence from Lassa virus__AIT17241__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagacgaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcccagcccggccucacgagcgcggucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcgucguggucgagaagaagaagcgcgggggcaaggaggagaucaccccgcacugcgcgcucauggacugcaucauguucgacgccgccgugagcgggggccugaacaccuccgugcugcgggccguccucccccgggacaugguguuccgcaccagcacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5596 - RNA, 2092 nt, Artificial Sequence
  mRNA product Design2 comprising derived and/or modified sequence from Lassa virus__AIT17245__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggacggggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccguggucgaccucgaguccgacgggaagccccagaaggcgggcagcaacaacuccaacaagagccugcaguccgccggccugaccgccgggcucacguacagccagcugaugacccugaaggacgccaugcugcagcucgacccgaacgccaagaccuggauggacaucgagggccgccccgaggaccccguggagaucgcgcuguaccagcccuccagcgggugcuacauccacuucuuccgggagccgaccgaccugaagcaguucaagcaggacgccaaguacucccacggcaucgacguggccgaccucuucgccgcccagcccgggcugacgagcgcggucaucgacgcccugccccgcaaccucgugaucacgugccagggcuccgacgacauccgcaagcugcuggagagccagggccggaaggacaucaagcucaucgacaucgcccugagcaagaccgacucccgcaaguacgagaacgccgugugggaccaguacaaggaccugugccacaugcacaccgggaucgucguggagaagaagaagcggggcgggaaggaggagaucaccccgcacugcgcgcucauggacugcaucauguucgacgccgccgucagcggcgggcugaacgccuccgugcugcgcgccgugcucccccgggacauggucuuccgcaccagcacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5597 - RNA, 2092 nt, Artificial Sequence
  mRNA product Design2 comprising derived and/or modified sequence from Lassa virus__AIT17247__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucauccuggccgccgaccuggagaagcucaagagcaaggugauccggaccgagcgcccccuguccagcgggguguacaugggcaaccuguccagccagcagcucgaccagcggcgcgcccugcugaacaugaucgggauguccggcggcaaccagggggcgcaggucggccgggacgggguggugcgcgucugggacgugaagaacgccgaccuccugaacaaccaguucggcaccaugccgagccugacgcucgccugccugaccaagcagggccagguggaccugaacgacgucgugcaggcccucaccgaccuggggcugaucuacaccgcgaaguaccccaacacguccgaccucgaccggcuggcccagagccaccccauccugaacaugaucgacaccaagaaguccagccucaacaucagcggcuacaacuucucccugggggccgccgugaaggccggcgcgugcaugcuggacgggggcaacaugcucgagaccaucaaggucagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaaggccggcuccaacaacagcaacaagucccugcagagcgcgggguucacggccggccugaccuacucccagcucaugacccugaaggacagcaugcugcagcuggacccgaacgccaagaccuggauggacaucgaggggcggcccgaggaccccgucgagguggcccucuaccagcccuccagcggcugcuacauccacuucuuccgcgagccgacggaccugaagcaguucaagcaggacgccaaguacucccacgggaucgacgugaccgaccuguucgcggcccagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgcggucugggaccaguacaaggaccucugccacaugcacaccggcgugguggucgagaagaagaagcgcgggggcaaggaggagaucacgccccacugcgcccugauggacugcaucauguucgacgccgccguguccgggggccugaagacccucgugcugcgggcgguccugccgcgcgacaugguguuccggaccagcacccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5598 - RNA, 2092 nt, Artificial Sequence
  mRNA product Design2 comprising derived and/or modified sequence from Lassa virus__AIT17251__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucauccuggccgccgaccuggagaagcucaagagcaaggugauccggaccgagcgcccccuguccagcgggguguacaugggcaaccuguccagccagcagcucgaccagcggcgcgcccugcugaacaugaucgggauguccggcggcaaccagggggcgcaggucggccgggacgggguggugcgcgucugggacgugaagaacgccgaccuccugaacaaccaguucggcaccaugccgagccugacgcucgccugccugaccaagcagggccagguggaccugaacgacgucgugcaggcccucaccgaccuggggcugaucuacaccgcgaaguaccccaacacguccgaccucgaccggcuggcccagagccaccccauccugaacaugaucgacaccaagaaguccagccucaacaucagcggcuacaacuucucccugggggccgccgugaaggccggcgcgugcaugcuggacgggggcaacaugcucgagaccaucaaggucagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaagacgggcuccaacaacagcaacaagucccugcagagcgccggguucaccgcgggccugaccuacucccagcucaugacccugaaggacagcaugcugcagcuggacccgaacgccaagacguggauggacaucgaggggcggcccgaggaccccgucgagguggcccucuaccagcccuccagcggcugcuacauccacuucuuccgcgagccgaccgaccugaagcaguucaagcaggacgccaaguacucccacgggaucgacgugaccgaccuguucgccgcgcagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgccgucugggaccaguacaaggaccucugccacaugcacaccggcgugguggucgagaagaagaagcgcgggggcaaggaggagaucacgccccacugcgcgcugauggacugcaucauguucgacgccgccguguccgggggccugaagacccucgugcugcgggccguccugccgcgcgacaugguguuccggaccagcacccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5599 - RNA, 2092 nt, Artificial Sequence
  mRNA product Design2 comprising derived and/or modified sequence from Lassa virus__AIT17255__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagcgggcccaggccgggcgcgacggcguggugcgggucugggacgugaagaacgccgagcuccugaacaaccaguucgggacgaugccgucccugacccucgcgugccugaccaagcagggccagguggaccugaacgacgccguccaggcccucaccgaccuggggcugaucuacacggugaaguaccccaacgccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagaccaucaaggucagcccccagacgauggacggcauccucaagagcauccugaaggugaagaagacccugggcauguucaucuccgacaccccgggggagcggaaccccuacgagaacauccuguacaagaucugccugagcggcgacggguggcccuacaucgccucccgcaccagcaucacgggccgggccugggagaacaccguggucgaccucgaguccaacgggaagccccagaaggcggacagcaacuccagcaacaagucccugcagagcgccggcuucaccgccggccugaccuacucccagcucaugacgcugaaggacgccaugcugcagcuggacccgaacgccaagaccuggauggacaucgaggggcgccccgaggaccccguggagaucgcguucuaccagcccagcuccggcugcuacauccacuucuuccgggagccgaccgaccucaagcaguucaagcaggacgccaaguacagccacgggaucgacgugaccgaccuguucgccgcccagcccggccugacguccgccgucaucgacgcgcucccccgcaacauggugaucacgugccaggggagcgacgacauccgcaagcugcuggagagccagggccggaaggacaucaagcucaucgacaucgcccuguccaagaccgacagccgcaaguacgagaacgccgucugggaccaguacaaggaccugugccacaugcacaccggcgugguggucgagaagaagaagcgcgggggcaaggaggagaucaccccgcacugcgcccucauggacugcaucauguucgacgcggccguguccgggggccugaacacccuggugcuccgggccguccugccccgggacaugguguuccgcaccagcacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5600 - RNA, 2092 nt, Artificial Sequence
  mRNA product Design2 comprising derived and/or modified sequence from Lassa virus__AIT17259__NP (opt1)
ggggcgcugccuacggagguggcagccaucuccuucucggcaucaagcuuaccaugagcgccuccaaggagaucaagagcuuccuguggacccagucccuccgccgggagcugagcuccuacugcagcaacaucaagcuccagguggucaaggacgcccaggcgcugcugcacggccuggacuucuccgaggugagcaacgugcagcgccucaugcggaaggagcgccgggacgacaacgaccugaagcgccugcgggaccucaaccaggccgucaacaaccugguggagcugaaguccacccagcagaaguccauccuccgcguggggacccugaccagcgacgaccugcucauccuggccgccgaccuggagaagcucaagagcaaggucacccggaccgagcgcccccuguccgccggcguguacauggggaaccugagcucccagcagcucgaccagcggcgcgcgcugcugaacaugcucggcaugagcggguccaaccagggcgcccgggccggccgcgacggggugguccgggugugggacgugaagaacgccgagcugcugaacaaccaguucggcacgaugccgagccucacccuggcgugccugaccaagcaggggcaggucgaccucaacgacgccgugcaggcccugaccgaccugggccucaucuacacggccaaguaccccaacaccuccgaccuggaccgccugacccagagccaccccauccucaacaugaucgacaccaagaaguccagccugaacaucagcggguacaacuucucccugggcgccgcggugaaggccggcgccugcaugcucgacgggggcaacaugcuggagacgaucaaggucagcccccagaccauggacgggauccugaaguccauccucaaggugaagaaggcccugggcauguucaucagcgacaccccgggcgagcggaaccccuacgagaacauccuguacaagaucugccucuccggggacggcuggcccuacaucgccagccgcaccuccaucacggggcgggcgugggagaacaccguggucgaccuggagagcgacggcaagccccagaaggccggguccaacagcuccaacaagagccugcaguccgccggcuucaccgccggccucaccuacagccagcugaugacgcugaaggacgccaugcugcagcucgacccgaacgcgaagaccuggauggacaucgaggggcgccccgaggaccccguggagaucgcccuguaccagcccuccagcggcugcuacauccacuucuuccgggagccgaccgaccugaagcaguucaagcaggacgccaaguacucccacgggaucgacgugaccgaccucuucgccgcccagcccggccugacgagcgcggucaucgacgcccugccccgcaacauggugaucacgugccaggggagcgacgacauccgcaagcuccuggagucccagggccggaaggacaucaagcugaucgacaucgcccucagcaagaccgacucccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucagcgggggccucaacgccuccgugcugcgggccgugcugccccgggacauggucuuccgcaccagcacgccccggguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5601 - RNA, 2092 nt, Artificial Sequence
  mRNA product Design2 comprising derived and/or modified sequence from Lassa virus__AIT17263__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacggucguggaccucgagagcgacggcaagccccagaaggccggcuccaacgggagcaacaagucccugcagagcgccggcuucaccgccgggcugaccuacucccagcucaugacccugaaggacgccaugcugcagcuggacccgaacacgaagaccuggauggacaucgagggccgccccgaggaccccguggaggucgcgcucuaccagcccagcuccgggugcuacauccacuucuuccgggagccgaccgaccugaagcaguucaagcaggacgccaaguacagccacggcaucgacgugaccgaccuguucgccgcccagcccggccucacguccgccgugaucgacgcgcugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucgucguggagaagaagaagcggggcgggaaggaggagaucaccccgcacugcgcccugauggacugcaucauguucgacgcggccguguccggcggccugaacaccagcguccuccgcgccgugcugccccgggacaugguguuccgcaccuccacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5602 - RNA, 2092 nt, Artificial Sequence
  mRNA product Design2 comprising derived and/or modified sequence from Lassa virus__AIT17267__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggguggucguggagaagaagaagcggggcgggaaggaggagaucacgccccacugcgcccugauggacugcaucauguucgacgccgccgugagcggcgggcugaacaccuccguccuccgcgccgugcugccgcgggacaugguguuccgcaccaccacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5603 - RNA, 2092 nt, Artificial Sequence
  mRNA product Design2 comprising derived and/or modified sequence from Lassa virus__AIT17271__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaagaccauccugaaggugaagaaggcccucgggauguucaucuccgacaccccgggcgagcggaaccccuacgagaacauccuguacaagaucugccugagcggggacggcuggcccuacaucgccucccgcacgagcaucaccgggcgggcgugggagaacaccguggucgaccucgaguccgacggcaagccccagaagaccggcagcaacaacuccaacaagagccugcaguccgccggguucgccgccggccugacguacagccagcucaugacccugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugacggaccuguucgccgcccagcccggccucaccagcgcggucaucgacgcccugccccgcaacauggugaucacgugccagggcuccgacgacauccgcaagcugcucgagagccaggggcggaaggacaucaagcugaucgacaucgcccuguccaaggccgacagccgcaaguacgagaacgcggugugggaccaguacaaggaccucugccacaugcacaccggcgucguggucgagaagaagaagcgcgggggcaaggaggagaucaccccgcacugcgcccugauggacugcaucauguacgacgccgccgugagcgggggccuguccaccagcgugcuccgggccguccugccccgggacaugguguuccgcaccuccacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5604 - RNA, 2092 nt, Artificial Sequence
  mRNA product Design2 comprising derived and/or modified sequence from Lassa virus__AIT17275__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcugaaguccacccagcagaaguccgugcuccgcgucgggacgcugaccagcgacgaccugcucacccuggccgccgaccuggagaagcucaaguccaaggugacccggacggagcgcccccugagcgccggcguguacauggggaaccuguccagccagcagcucgaccagcggcgcgcgcugcugaacaugaucggcauguccggcgggaaccagggcgcccggaccgggaaggacggcgucgugcgcaucugggacgugaagaacgccgaccuccugaacaaccaguucgggaccaugccgagccugacccucgccugccugacgaagcagggccaggucgaccugaacgacguggugcaggcgcucaccgaccugggccugaucuacaccgccaaguaccccaacaucuccgaccucgaccggcuggcccagagccaccccauccugaagaugaucgacaccuccaagagcagccucaacaucuccggguacaacuucagccugggcgccgccgucaaggcgggggccugcaugcuggacggcggcaacaugcucgagacggugaaggugagcccccagaccauggacgggauccucaagagcauccugaaggucaagaagucccugggcauguucaucagcgacaccccgggggagcgcaaccccuacgagaacauccuguacaagaucugccuguccggcgacggguggcccuacaucgccagccggaccuccaucacgggccgcgccugggagaacaccgugguggaccucgagagcgacggcaagccccagaaggucggguccaacaacagcaacaagucccugcagagcaccggcuucaccgccgggcugacguacucccagcucaugacccugaaggacgcgaugcugcagcuggacccgaacgccaagaccuggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugacggaccuguucgccgcgcagcccggccucaccuccgccgucaucgacacccugccccggaacauggugaucacgugccaggggagcgacgacaucggcaagcugcucgagagccaggggcgcaaggacaucaagcugaucgacaucgcccuguccaagaccgacagccgcaaguacgagaacgccgucugggaccaguacaaggaccucugccacaugcacaccggcgugguggucgagaagaagaagcgcgggggcaaggaggagaucaccccgcacugcgcccugauggacugcaucauguucgacgcggccguguccggcgggcugaacgccagcgugcuccgggccguccugccccgggacaugguguuccgcaccuccacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5605 - RNA, 2092 nt, Artificial Sequence
  mRNA product Design2 comprising derived and/or modified sequence from Lassa virus__AIT17277__NP (opt1)
ggggcgcugccuacggagguggcagccaucuccuucucggcaucaagcuuaccaugagcgccuccaaggagaucaagagcuuccuguggacccagucccuccgccgggagcugagcuccuacugcagcaacaucaagcuccagguggucaaggacgcccaggcgcugcugcacggccuggacuucuccgaggugagcaacgugcagcgccucaugcggaaggagcgccgggacgacaacgaccugaagcgccugcgggaccucaaccaggccgucaacaaccugguggagcugaaguccacccagcagaaguccauccuccgcguggggacccugaccuccgacgaccugcucauccuggccgccgaccuggagaagcucaagagcaaggucacccggaccgagcgcccccuguccgccggcguguacauggggaaccugagcucccagcagcucgaccagcggcgcgcgcugcugagcaugaucggcauguccgggagcaaccagggcgcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagagccaccccauccugaacaugaucgacaccaagaaguccagccucaacaucuccggguacaacuucagccugggcgccgcggugaaggccggcgccugcaugcuggacgggggcaacaugcucgagacgaucaaggucagcccccagaccauggacgggauccucaagagcauccugaaggugaagaaggcccugggcauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccgggagcaacaacuccaacaagagccugcaguccgccggcuucaccgccggccugaccuacagccagcucaugacgcugaaggacgccaugcugcagcuggacccgaacgcgaagaccuggauggacaucgaggggcgccccgaggaccccguggagguggcccucuaccagcccuccagcggcugcuacauccacuucuuccgggagccgaccgaccugaagcaguucaagcaggacgccaaguacucccacgggaucgacgucaccgaccuguucgccgcccagcccggccucacgagcgcggugaucgacgcccugccccgcaacauggugaucacgugccaggggagcgacgacauccgcaagcugcucgagucccagggccggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucaccccgcacugcgcgcugauggacugcaucauguucgacgccgccgugagcgggggccugaacaccuccguccuccgggccgugcugccccgggacaugguguuccgcaccagcacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5606 - RNA, 2092 nt, Artificial Sequence
  mRNA product Design2 comprising derived and/or modified sequence from Lassa virus__AIT17281__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggcccgggccggccgcgacgggguggugcggaucugggacgucaagaacgccgagcuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccuccaccacgaacagcaacaagucccugcagagcgcgggcuucgccgccgggcugaccuacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgacggaccugaagcaguucaagcaggacgccaaguacagccacggcaucgacgucaccgaccuguucgccgcccagcccgggcucaccuccgccgugaucgacacccugccccgcaacauggugaucacgugccagggcagcgaggacauccgccggcugcucgagagccagggccgcaaggacaucaagcugaucgacaucgcgcuguccaagaccgacagccggaaguacgagaacgccgucugggaccaguacaaggaccucugccacaugcacaccgggguggucguggagaagaagaagaagggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5607 - RNA, 2092 nt, Artificial Sequence
  mRNA product Design2 comprising derived and/or modified sequence from Lassa virus__AIT17285__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgcagcaugcggaaggagcgccgggacgacaacgaccucaagcgccugcgggaccugaaccaggccgucaacaaccucguggagcugaaguccacccagcagaaguccauccugcgcgugggcacccucaccagcgacgaccugcugauccucgccgccgaccuggagaagcucaagagcaaggucacccggaccgagcgcccccuguccgccgggguguacaugggcaaccugagcucccagcagcuggaccagcggcgcgcgcuccugaacaugaucgggaugagcggcuccaaccagggcgcccgggccgggcgcgacggcgugguccgggugugggacgugaagaacgccgagcugcucaacaaccaguucgggacgaugccgagccugacccuggcgugccucaccaagcagggccaggucgaccugaacgacguggugcaggcccugaccgaccucgggcugaucuacacggccaaguaccccaacgccuccgaccuggaccgccucacccagagccaccccauccugaacaugaucgacaccaagaaguccagccugaacaucagcggcuacaacuucucccucggcgccgcggucaaggccggggccugcaugcuggacggcgggaacaugcuggagaccaucaaggugagcccccagacgauggacggcauccucaaguccauccugaaggugaagaaggcccugggcauguucaucagcgacaccccgggggagcggaaccccuacgagaacauccucuacaagaucugccuguccggcgacggguggcccuacaucgccagccgcaccuccaucaccggccgggcgugggagaacacgaucgucgaccuggagagcgacgggaagccccagaaggccggcaacaacggcuccaacaagagccuccaguccgccggguucaccgccggccugaccuacagccagcugaugacccucaaggacgccaugcugcagcuggacccgaacgcgaagacguggauggacaucgaggggcgccccgaggaccccguggagaucgcccuguaccagcccuccagcggcugcuacauccacuucuuccgggagccgaccgaccucaagcaguucaagcaggacgccaaguacucccacgggaucgacgugaccgaccuguucgccgcccagcccggccugaccagcgcggucaucgacgcccucccccgcaaccuggugaucacgugccagggcuccgacgacauccgcaagcugcucgagagccaggggcggaaggacaucaagcugaucgacaucgcccugagcaagaccgacucccgcaaguacgagaacgccgugugggaccaguacaaggaccucugccacaugcacaccggcaucgucguggagaagaagaagcgcgggggcaaggaggagaucacgccccacugcgcgcugauggacugcaucauguucgacgccgccgucagcgggggccugaacaccuccgugcuccgggccgugcugccgcgggacauggucuuccgcaccagcacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5608 - RNA, 2092 nt, Artificial Sequence
  mRNA product Design2 comprising derived and/or modified sequence from Lassa virus__AIT17289__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggugcgggccggccgcgacggggugguccggaucugggacgugaagaacgccgagcuccugaacaaccaguucggcacgaugccgagccugacccucgccugccugaccaagcagggccagguggaccugaacgacgucgugcaggcgcucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggccggcgcgugcaugcuggacgggggcaacaugcucgagacgaucaaggucagcccccagaccauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccggcuccaucaacagcaacaagucccugcagagcaccggguucgccgcgggccugacguacucccagcucaugacccugaaggacgccaugcugcagcuggacccgaacgccaagaccuggauggacaucgaggggcgccccgaggaccccgucgagaucgcccucuaccagcccagcuccggcugcuacauccacuucuuccgggagccgaccgaccugaagcaguucaagcaggacgccaaguacagccacgggaucgacgugacggaccuguucgcggcccagcccggccucaccuccgccgugaucgacgcccugccccgcaacauggucaucacgugccagggcagcgacgacauccgcaagcugcucgagagccaggggcggaaggacaucaagcugaucgacaucgcccuguccaagaccgacagccgcaaguacgagaacgcggugugggaccaguacaaggaccucugccacaugcacaccggcaucgucguggagaagaagaagcgcgggggcaaggaggagaucaccccgcacugcgcccugauggacugcaucauguucgacgccgccguguccgggggccugaacaccagcguccuccgggcggugcugccccgggacaugguguuccgcaccuccacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5609 - RNA, 2092 nt, Artificial Sequence
  mRNA product Design2 comprising derived and/or modified sequence from Lassa virus__AIT17293__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaaguccaaggugacccggaccgagcgcccccugagcgccggggucuacaugggcaaccuguccacgcagcagcucgaccagcggcgcgcgcugcugaacaugaucgggaugagcggcggcaaccagggggcccgggccggccgcgacgggguggugcgggucugggacgugaagaacgccgaccuccugaacaaccaguucggcaccaugccgucccugacccucgcgugccugaccaagcagggccagguggaccugaacgacgucgugcaggcccucacggaccuggggcugaucuacaccgccaaguaccccaacaccagcgaccucgaccgccugacccagucccaccccauccugaacaugaucgacacgaacaagagcucccucaacaucagcggcuacaacuucagccugggggccgccgugaaggcgggcgccugcaugcuggacgggggcaacaugcucgagaccaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccguggucgaccucgaguccgacggcaagccccagaaggcgggcgggaacaacagcaacaagucccugcagagcgccggcuucaccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgugacggaccuguucgccgcccagcccggccucaccuccgccgucaucgacgcgcugccccgcaacauggugaucacgugccaggggagcgacgacauccgcaagcugcucgagucccagggccggaaggacaucaagcugaucgacaucgcccugagcaagaccgacucccgcaaguacgagaacgccgucugggaccaguacaaggaccucugcaacaugcacaccgggaucgugguggagaagaagaagcggggcgggaaggaggagaucaccccgcacugcgcccugauggacugcaucauguucgacgcggccgucagcggcggcaugaacaccagcgugcugcgcgccgugcucccccgggacauggucuuccgcaccuccacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5610 - RNA, 2092 nt, Artificial Sequence
  mRNA product Design2 comprising derived and/or modified sequence from Lassa virus__AIT17295__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacgaucgucgaccucgagagcgacggcaagccccagaaggccggcuccaacgggagcaacaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccgcccagcccggccucaccuccgcgaucaucgacgcccugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucguggucgagaagaagaagcggggcgggaaggaggagaucacgccccacugcgcgcugauggacugcaucauguucgacgccgccguguccggcggccugaacaccagcguccuccgcgccgugcugccgcgggacaugguguuccgcaccuccacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5611 - RNA, 2092 nt, Artificial Sequence
  mRNA product Design2 comprising derived and/or modified sequence from Lassa virus__AIT17299__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagggggcccggacgggccgcgacgggguggugcgggucugggacgugaagaacgccgagcuccugaacaaccaguucggcaccaugccgucccugacccucgccugccugaccaagcagggccagguggaccugaacgacgucgugcaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccguggucgaccucgaguccgacggcaagccccagaaggccggcagcaacaacuccaacaagagccugcaguccgcgggguucaccgccggccugacguacagccagcucaugacccugaaggacgccaugcugcagcuggacccgaacgccaagaccuggauggacaucgaggggcgccccgaggaccccguggagaucgcccucuaccagcccuccagcggcugcuacauccacuucuuccgggagccguccgaccugaagcaguucaagcaggacgcgaaguacagccacgggaucgacgugaccgaccuguucgccgcccagcccggccucacguccgccgucaucgacgcccugccccgcaacauggugaucacgugccagggcagcgacgacauccgcaagcuguucgagagccaggggcggaaggacaucaagcucaucgacaucgcgcuguccaagaccgacagccgcaaguacgagaacgccgucugggaccaguacaaggaccugugccacaugcacaccggcgugguggucgagaagaagaagcgcgggggcaaggaggagaucaccccgcacugcgcccucauggacugcaucauguucgacgccgcgguguccgggggccugaacagccuggugcuccgggccguccugccccgggacaugguguuccgcaccuccacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5612 - RNA, 2092 nt, Artificial Sequence
  mRNA product Design2 comprising derived and/or modified sequence from Lassa virus__AIT17303__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcugguccagagccaccccauccugaacaugaucgacaccaagaaguccagccucaacaucagcggcuacaacuucucccugggggccgccgugaaggccggcgccugcaugcuggacgggggcaacaugcucgagaccaucaaggugagcccccagaccauggacggcauccugaaguccauccugaaggucaagaaggcgcucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaaggccggcuccaacaacagcaacaagucccugcagagcgccggguucacggcgggccugaccuacucccagcucaugacccugaaggacagcaugcugcagcuggacccgaacgccaagaccuggauggacaucgaggggcggcccgaggaccccguggaggucgcccucuaccagcccuccagcggcugcuacauccacuucuuccgcgagccgacggaccugaagcaguucaagcaggacgccaaguacucccacgggaucgacgugaccgaccuguucgccgcgcagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaagacccucgugcugcgggccgugcugccgcgcgacauggucuuccggaccagcacccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5613 - RNA, 2092 nt, Artificial Sequence
  mRNA product Design2 comprising derived and/or modified sequence from Lassa virus__AIT17307__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacgcugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggacgggccgcgacggggucgugcgggugugggacgucaagaacgccgagcuccugaacaaccaguucggcaccaugccgucccugacccucgccugccugaccaagcagggccagguggaccugaacgacgugguccaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgugguggaccucgaguccgacggcaagcugcagaagaccggcagcaacaacuccaacaagagccugcaguccgccggguucacggcgggccucaccuacagccagcugaugacccugaaggacgccaugcugcagcucgaccccaacgccaagaucuggauggacaucgaggggcgcccggaggaccccgucgagaucgcccuguaccagcccuccagcggcugcuacauccacuucuuccgggagcccaccgaccugaagcaguucaagcaggacgccaaguacucccacgggaucgacgugacggaccucuucgcggcccagccgggccugaccagcgccgugaucgacgcccugccccgcaacauggucaucacgugccagggcuccgacgacauccgcaagcuccuggagagccaggggcggaaggacaucaagcugaucgacaucgcccucaacaagaccgacagccgcaaguacgagaacgcggugugggaccaguacaaggaccugugccacaugcacaccggcgucgugguggagaagaagaagaagggcgggaaggaggagaucacgccccacugcgcccugauggacugcaucauguucgacgccgccgucuccgggggccucaacaccagcgugcugcgggcggugcugccccgcgacauggucuuccggaccuccaccccgcgcguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5614 - RNA, 2092 nt, Artificial Sequence
  mRNA product Design2 comprising derived and/or modified sequence from Lassa virus__AIT17311__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacggucguggaccucgagagcgacggcaagccccagaaggccggcuccaacgggagcaacaagucccugcagagcgccggcuucaccgccgggcugaccuacucccagcucaugacccugaaggacgccaugcugcagcuggacccgaacgcgaagacguggauggacaucgagggccgccccgaggaccccguggaggucgcccucuaccagcccagcuccgggugcuacauccacuucuuccgggagccgaccgaccugaagcaguucaagcaggacgccaaguacagccacggcaucgacgugaccgaccuguucgccgcccagcccggccucaccuccgcggugaucgacgcccugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucgucguggagaagaagaagcggggcgggaaggaggagaucacgccccacugcgcgcugauggacugcaucauguucgacgccgccguguccggcggccugaacaccagcguccuccgcgccgugcugccgcgggacaugguguuccgcaccuccacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5615 - RNA, 2092 nt, Artificial Sequence
  mRNA product Design2 comprising derived and/or modified sequence from Lassa virus__AIT17315__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgucgugcgggugugggacgucaagaacguggagcuccugaacaaccaguucgggacgaugccgucccugacccucgccugccugaccaagcagggccagguggaccugaacgacgcgguccaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgacaccccgggggagcggaaccccuacgagaacauccuguacaagaucugccugagcggcgacggguggcccuacaucgccucccgcaccagcaucacgggccgggccugggagaacaccgugguggaccucgaguccgacgggaagccccagaaggcgggcagcaacuccagcaacaagucccugcagagcgccggcuucaccgccgggcugaccuacucccagcucaugacgcugaaggacgccaugcugcagcuggacccgaacgccaagaccuggauggacaucgagggccgccccgaggaccccgucgagaucgcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgugaucgacgcgcugccccgcaacauggucaucacgugccagggcagcgacgacauccgcaagcugcucgagagccagggccggaaggacaucaagcugaucgacaucgcccuguccaagaccgacagccgcaaguacgagaacgccgugugggaccaguacaaggaccucugccacaugcacaccgggaucgucguggagaagaagaagaagggcuccaaggaggagaucaccccgcacugcgcccugauggacugcaucauguucgacgcggccgugagcgggggccugaacgccuccguccuccgggccgugcugccccgcgacaugguguuccggaccagcacgccccgcgucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5616 - RNA, 2092 nt, Artificial Sequence
  mRNA product Design2 comprising derived and/or modified sequence from Lassa virus__AIT17319__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggacaugcucaacaaccaguucggcaccaugccgagccugacgcuggccugccucaccaagcaggggcaggucgaccugaacgacguggugcaggcccugaccgaccucggccugaucuacaccgcgaaguaccccaacacguccgaccuggaccggcucgcccagagccaccccauccugaacaugaucgacaccaagaaguccagccugaacaucagcggcuacaacuucucccucggggccgccgucaaggccggcgcgugcaugcuggacgggggcaacaugcuggagaccaucaaggugagcccccagaccauggacggcauccucaaguccauccugaaggugaagaaggcccuggggauguucaucagcgagacgccgggcgagcgcaaccccuacgagaacauccucuacaagaucugccuguccggggacggcuggcccuacaucgccagccggaccuccaucaccgggcgcgccugggagaacaccaucgucgaccuggagagcgacggcaagccccagaaggccggcuccaacaacagcaacaagucccuccagagcgcgggguucacggccggccugaccuacucccagcugaugacccucaaggacagcaugcugcagcuggacccgaacgccaagaccuggauggacaucgaggggcggcccgaggaccccguggagguggcccuguaccagcccuccagcggcugcuacauccacuucuuccgcgagccgacggaccucaagcaguucaagcaggacgccaaguacucccacgggaucgacgucaccgaccuguucgcggcccagcccggccugaccagcgccgugaucgaggcccucccccggaacauggucaucacgugccagggcagcgacgacauccgcaagcugcuggagucccaggggcgcaaggacaucaagcucaucgacaucgugcugaacaagaccgacagccggaaguacgagaacgccgugugggaccaguacaaggaccugugccacaugcacaccggcgucgugguggagaagaagaagcgcgggggcaaggaggagaucacgccccacugcgcgcucauggacugcaucauguucgacgccgccgucuccgggggccugaagaccauggugcugcgggccgugcucccgcgcgacauggucuuccggaccagcacccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5617 - RNA, 2092 nt, Artificial Sequence
  mRNA product Design2 comprising derived and/or modified sequence from Lassa virus__AIT17323__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcuggcccagagccaccccauccugaacaugaucgacaccaagaaguccagccucaacaucagcggcuacaacuucucccugggggccgccgucaaggccggcgcgugcaugcuggacgggggcaacaugcucgagaccaucaaggugagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucgucgaccucgagagcgacggcaagccccagaaggccggcuccaacaacagcaacaagucccugcagagcgcgggguucacggccggccugaccuacucccagcucaugacccugaaggacagcaugcugcagcuggacccgaacgccaagaccuggauggacaucgaggggcggcccgaggaccccguggagguggcccucuaccagcccuccagcggcugcuacauccacuucuuccgcgagccgacggaccugaagcaguucaagcaggacgccaaguacucccacgggaucgacgucaccgaccuguucgcggcccagcccggccucaccagcgccgugaucgaggcccugccccggaacauggucaucacgugccagggcagcgacgacauccgcaagcugcucgagucccaggggcgcaaggacaucaagcugaucgacaucgcccugaacaagaccgacagccggaaguacgagaacgcggugugggaccaguacaaggaccucugccacaugcacaccggcguggucguggagaagaagaagcgcgggggcaaggaggagaucacgccccacugcgcccugauggacugcaucauguucgacgccgccguguccgggggccugaagacccucguccugcgggcggugcugccgcgcgacaugguguuccggaccagcacccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5618 - RNA, 2092 nt, Artificial Sequence
  mRNA product Design2 comprising derived and/or modified sequence from Lassa virus__AIT17325__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcugaacaugaucgggaugacgggcggcucccgcggggcccaggccggcggggacggcguggugcgggucugggacgugaagaacgccgaccuccugaacaaccaguucgggaccaugccgagccugacccucgcgugccugaccaagcagggccagguggaccugaacgacgucgugcaggcccucacggaccugggccugaucuacaccgccaaguaccccaacaccuccgaccucgaccggcugacccagagccaccccauccugaacaugaucgacacgaagaaguccagccucaacaucagcggguacaacuucucccugggcgccgccgugaaggcgggggccugcaugcuggacggcggcaacaugcucgagaccaucaaggucagcccccagaccauggacgggauccugaaguccauccugaaggugaagaagucccucggcauguucaucagcgacaccccgggggagcgcaaccccuacgagaacauccuguacaagaucugccugagcggcgacggguggcccuacaucgccucccggacgagcaucaccggccgcgccugggagaacaccguggucgaccucgaguccgacggcaagccccagaaggccgggggcaacaacagcaacaagucccugcagagcgcgggguucaccgccggccugacguacucccagcucaugacccugaaggacaccaugcugcagcuggacccgaacgccaagaccuggauggacaucgaggggcggcccgaggaccccguggagguggcccucuaccagcccagcuccggcugcuacauccacuucuuccgcgagccgacggaccugaagcaguucaagcaggacgccaaguacagccacggcaucgacgucaccgaccuguucgcggcccagcccgggcucaccuccgccgugaucgaggcccugccccggaacauggucaucacgugccagggcagcgacgacauccgcaagcugcucgagucccaggggcgcaaggacaucaagcugaucgacaucgcccugagcaagguggacagccggaaguacgagaacgcggugugggaccaguacaaggaccucugccacaugcacaccggcgucgugguggagaagaagaagcgcgggggcaaggaggagaucacgccccacugcgcccugauggacugcaucauguucgacgccgccgucuccggcgggcugaacacccucgugcugcgggcggugcugccgcgcgacauggucuuccggaccagcacccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5619 - RNA, 2092 nt, Artificial Sequence
  mRNA product Design2 comprising derived and/or modified sequence from Lassa virus__AIT17329__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccagaccgucaacaaccugguggagcugaaguccacccagcagaaguccauccuccgcgugggcacccugaccagcgacgaccugcucauccuggccgccgaccuggagaagcucaagagcaaggucauccggaccgagcgcccccuguccgccgggguguacaugggcaaccugagcucccagcagcucgaccagcggcgcgcccugcugaacaugaucgggaugagcuccggcaaccagggcgcgcaggccgggcgggacggcgugguccgcgugugggacgugaagaacgccgagcuccugaacaaccaguucgggacgaugccgagccugacccucgccugccugaccaagcagggccaggucgaccugaacgacgcggugcaggcccucaccgaccuggggcugaucuacacggccaaguaccccaacaccuccgaccucgaccggcugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggucagcccccagaccauggacggcauccugaaguccauccugaaggugaagaaggcccucggcauguucaucagcgacaccccgggggagcgcaaccccuacgagaacauccuguacaagaucugccuguccggcgacggguggcccuacaucgccagccggaccuccaucacgggccgcgccugggagaacaccguggucgaccucgagagcgacgggaugccccagaaggcgggcuccagcuccagcaacaagucccugcagagcgccggcuucguggccgggcugaccuacucccagcucaugacccugaaggacgccaugcugcagcuggacccgaacgccaagacguggauggacaucgagggccggcccgaggaccccguggagaucgcgcucuaccagcccagcuccgggugcuacauccacuucuuccgcgagccgaccgaccugaagcaguucaagcaggacgccaaguacagccacggcaucgacgucaccgaccuguucgccgcccagcccgggcucaccagcgccgugaucgacgcgcugccccggaacauggugaucacgugccagggcuccgacgacauccgcaagcugcucgagagccagggccgcaaggacaucaagcugaucgacaucgcccuguccaaggccgacagccggaaguacgagaacgccgucugggaccaguacaaggaccucugccacaugcacaccgggguggucguggagaagaagaagcgcggcgggaaggaggagaucacgccccacugcgcgcugauggacugcaucauguacgacgccgccguguccggcgggcugaacaccagcguccuccgggccgugcugccgcgcgacaugguguuccggaccuccacgccccgcgucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5620 - RNA, 2092 nt, Artificial Sequence
  mRNA product Design2 comprising derived and/or modified sequence from Lassa virus__AIT17333__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggaucguggucgagaagaagaagcggggcgggaaggaggagaucacgccccacugcgcccugauggacugcaucauguucgacgccgccgugagcggcgggcugaacaccuccgugcuccgcgccguccugccgcgggacaugguguuccgcaccagcacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5621 - RNA, 2092 nt, Artificial Sequence
  mRNA product Design2 comprising derived and/or modified sequence from Lassa virus__AIT17335__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccauccuccgcgugggcacccugaccuccgacgaccugcucauccuggccgccgaccuggagaagcucaagagcaaggucacccggaccgagcgcccccuguccgccgggguguacaugggcaaccugagcucccagcagcucgaccagcggcgcgcgcugcugagcaugaucgggauguccagcggcgugcagggcgcccgggccgggcgcgacggcgucgugcgggugugggacgucaagaacgccgagcuccugaacaaccaguucgggacgaugccgucccugacccucgcgugccugaccaagcagggccagguggaccugaacgacgugguccaggcccucaccgaccuggggcugaucuacacggccaaguaccccaacaccagcgaccucgaccgccugacccagagccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgagaccccgggggagcggaaccccuacgagaacauccuguacaagaucugccugagcggcgacggguggcccuacaucgccucccgcaccagcaucacgggccgggccugggagaacaccgugguggaccucgaguccgacgggaagccccagaaggcgggcagcaacaacuccaacaagagccugcaguccaccggcuucgccgccgggcugaccuacagccagcucaugacgcugaaggacgccaugcugcagcuggacccgaacgccaagaccuggauggacaucgagggccgccccgaggaccccgucgagguggcgcucuaccagcccuccagcgggugcuacauccacuucuuccgggagccgaccgaccugaagcaguucaagcaggacgccaaguacucccacggcaucgacgugaccgaccuguucgccgcccagcccgggcucacgagcgccgucaucgacgcgcugccccgcaacauggugaucacgugccagggcagcgacgacaucaagaagcugcucgagucccagggccgcaaggacaucaagcugaucgacaucgcccugagcaagaccgacucccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccgugagcggcgggcugaacaccuccgugcuccgggccguccugccccgcgacaugguguuccggaccagcacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5622 - RNA, 2092 nt, Artificial Sequence
  mRNA product Design2 comprising derived and/or modified sequence from Lassa virus__AIT17341__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaaguccauccugaaggugaagaaggcccucgggauguucaucagcgacgccccgggcgagcggaaccccuacgagaacauccuguacaagaucugccuguccggggacggcuggcccuacaucgcgagccgcaccuccaucaccgggcgggccugggagaacacgguggucgaccucgagagcgacggcaagccccagaaggccggcuccaacgggagcaacaagucccugcagagcgccggcuucaccgccgggcugaccuacucccagcucaugacccugaaggacgcgaugcugcagcuggacccgaacgccaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccgcgcagcccggccucaccuccgccgucaucgacgcccugccccgcaacauggugaucacgugccaggggagcgacgacauccgcaagcuguucgagucccagggccggaaggacaucaagcucaucgacaucgcccugagcaaggcggacagccgcaaguacgagaacgccgugugggaccaguacaaggaccugugccacaugcacaccggggucguggucgagaagaagaagcggggcgggaaggaggagaucacgccccacugcgcccucauggacugcaucauguucgacgccgccguguccggcggccugaacaccagcgugcugcgcgcgguccucccgcgggacaugguguuccgcaccuccacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5623 - RNA, 2092 nt, Artificial Sequence
  mRNA product Design2 comprising derived and/or modified sequence from Lassa virus__AIT17345__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcuccggcgugcagggcgcccgggccgggcgcgacggcgucgugcgggugugggacgucaagaacgccgagcuccugaacaaccaguucgggacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggugagcccccagaccauggacggcauccugaaguccauccugaaggucaagaaggcccucggcauguucaucagcgagaccccgggggagcggaaccccuacgagaacauccuguacaagaucugccuguccggcgacggguggcccuacaucgccagccgcaccuccaucacgggccgggccugggagaacaccgugguggaccucgagagcgacgggaagccccagaaggcgggcuccaacaacagcaacaagucccugcagagcgccggcuucaccgccgggcugaccuacucccagcucaugacgcugaaggacgccaugcugcagcuggacccgaacgccaagaccuggauggacaucgagggccgccccgaggaccccgucgagguggcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgucaucgacgcgcugccccgcaacauggugaucacgugccagggcagcgacgacaucaagaagcugcucgagagccagggccgcaaggacaucaagcugaucgacaucgcccuguccaagaccgacagccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccguguccggcgggcugaacaccagcgugcuccgggccguccugccccgcgacaugguguuccggaccuccacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5624 - RNA, 2092 nt, Artificial Sequence
  mRNA product Design2 comprising derived and/or modified sequence from Lassa virus__AIT17351__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcucaagagcacccagcagaaguccgugcugcgcgucgggacccugaccagcgacgaccugcucauccuggccgccgaccuggagaagcucaaguccaaggugauccggaccgagcgcccccugagcgccggcguguacauggggaaccuguccagccagcagcucgagcagcggcgcgcgcugcugaacaugaucggcauguccagcggcaaccagggggcccggaccggcaaggacggggucgugcgcaucugggacgugaagaacgccgaccuccugaacaaccaguucggcaccaugccgucccugacccucgccugccugaccaagcaggggcaggucgaccugaacgacguggugcaggcgcucaccgaccugggccugaucuacacggccaaguaccccaacaccagcgaccucgaccggcugacccagucccaccccauccugaacauggucgacaccagcaagagcucccucaacaucagcggcuacaacuucucccugggggccgccgugaaggccggcgcgugcaugcuggacgggggcaacaugcucgagacgaucaaggugagcccccagaccauggacggcauccugaaguccauccugaaggucaagaagucccucgggauguucgugagcgacaccccgggcgagcgcaaccccuacgagaacauccuguacaagaucugccugagcggggacggcuggcccuacaucgccucccggaccagcaucacggggcgcgccugggagaacaccguggucgaccucgaguccaacggcaagccccagaaggccggcagcaacaacuccaacaagagccugcaguccaccggguucaccgccggccugacguacagccagcucaugacccugaaggacgcgaugcugcagcuggacccgaacgccaagaccuggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugacggaccuguucgccgcgcagcccggccucaccagcgccgucaucgacacccugccccggaacauggugaucacgugccagggcagcgacgacauccgcaagcugcucgagucccaggggcgcaaggacaucaagcugaucgacaucgcccugagcaagaucgacucccggaaguacgagaacgccgucugggaccaguacaaggaccucugccacaugcacaccggcgugguggucgagaagaagaagcgcgggggcaaggaggagaucacgccccacugcgcccugauggacugcaucauguucgacgcggccgugagcgggggccugaacgccuccgugcuccgggccguccugccgcgcgacaugguguuccggaccagcacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5625 - RNA, 2092 nt, Artificial Sequence
  mRNA product Design2 comprising derived and/or modified sequence from Lassa virus__AIT17359__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccauccuccgcgugggcacccugaccagcgacgaccugcucauccuggccgccgaccuggagaagcucaagagcaaggucacccggaccgagcgcccccuguccgccgggguguacaugggcaaccugagcucccagcagcucgaccagcggcgcgcgcugcugaacaugcucgggaugagcggcuccaaccagggcgcccgggccgggcgcgacggcgugguccgggugugggacgugaagaacgccgagcugcugaacaaccaguucgggacgaugccgagccucacccuggcgugccugaccaagcagggccaggucgaccucaacgacgccgugcaggcccugaccgaccuggggcucaucuacacggccaaguaccccaacaccuccgaccuggaccgccugacccagagccaccccauccucaacaugaucgacaccaagaaguccagccugaacaucagcggcuacaacuucucccugggcgccgcggugaaggccggggccugcaugcucgacggcgggaacaugcuggagacgaucaaggucagcccccagaccauggacggcauccugaaguccauccucaaggugaagaaggcccugggcauguucaucagcgacaccccgggggagcggaaccccuacgagaacauccuguacaagaucugccucuccggcgacggguggcccuacaucgccagccgcaccuccaucacgggccgggcgugggagaacaccguggucgaccuggagagcgacgagaagccccagaaggccggguccaacagcuccaacaagagccugcaguccgccggcuucaccgccggccucaccuacagccagcugaugacgcugaaggacgccaugcugcagcucgacccgaacgcgaagaccuggauggacaucgaggggcgccccgaggaccccguggagaucgcccuguaccagcccuccagcggcugcuacauccacuucuuccgggagccgaccgaccugaagcaguucaagcaggacgccaaguacucccacgggaucgacgugaccgaccucuucgccgcccagcccggccugacgagcgcggucaucgacgcccugccccgcaacauggugaucacgugccaggggagcgacgacauccgcaagcuccuggagucccagggccggaaggacaucaagcugaucgacaucgcccucagcaagaccgacucccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucagcgggggccucaacgccuccgugcugcgggccgugcugccccgggacauggucuuccgcaccagcacgccccggguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5626 - RNA, 2092 nt, Artificial Sequence
  mRNA product Design2 comprising derived and/or modified sequence from Lassa virus__AIT17361__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccuccgacgaccugcucgugcuggccgccgaccuggagaagcucaagagcaaggugacccggaccgagcgcccccuguccgccggggucuacaugggcaaccugagcucccagcagcucgaccagcggcgcgcgcugcugaacaugaucgggaugagcggcggcaaccagggggcccgggccggccgcgacgggguggugcggaucugggacgucaagaacgccgagcuccugaacaaccaguucggcacgaugccgucccugacccucgcgugccugaccaagcagggccagguggaccugaacgacgugguccaggcccucaccgaccuggggcugaucuacacggccaaguaccccaacaccagcgaccucgaccgccugacccagucccaccccauccugaacaugaucgacaccaagaaguccagccucaacaucagcggcuacaacuucagccugggggccgccgugaaggcgggcgccugcaugcuggacgggggcaacaugcucgagacgaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccaucguggaccucgaguccgacggcaagccccagaagaccaacaacaccaacagcaacaagucccugcagagcgcgggcuucgccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgucacggaccuguucgccgcccagcccgggcucaccuccgccgugaucgacacccugccccgcaacauggugaucacgugccagggcagcgaggacauccgccggcugcucgagucccagggccgcaaggacaucaagcugaucgacaucgcgcugagcaagaccgacagccggaaguacgagaacgccgucugggaccaguacaaggaccucugccacaugcacaccgggguggucguggagaagaagaagaagggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5627 - RNA, 2092 nt, Artificial Sequence
  mRNA product Design2 comprising derived and/or modified sequence from Lassa virus__AIT17365__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccaggccgggcgggacggcgugguccgcgugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgcgucccggaccagcaucaccggccgcgccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugaccgaccuguucgccgcgcagcccggccucaccagcgccgucaucgacgcccugccccggaacauggugaucacgugccagggcuccgacgacauccgcaagcuguucgagagccaggggcgcaaggacaucaagcucaucgacaucgcccugagcaagaccgacucccggaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgcgacauggucuuccggaccagcacgccccgcguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5628 - RNA, 2092 nt, Artificial Sequence
  mRNA product Design2 comprising derived and/or modified sequence from Lassa virus__AIT17371__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccaggccgggcgggacggcgugguccgcgugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgcgucccggaccagcaucaccggccgcgccugggagaacacgguggucgaccucgaguccgacgggaagccccagaaggccggcagcaacuccagcaacaagucccugcagagcgccggcuucaccgccgggcugaccuacucccagcucaugacccugaaggacgcgaugcugcagcuggacccgaacgccaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccgcgcagcccgggcucaccuccgccgucaucgacgcccugccccggaacauggugaucacgugccagggcagcgacgacauccgcaagcuguucgagagccagggccgcaaggacaucaagcucaucgacaucgcccuguccaagaccgacagccggaaguacgagaacgcggugugggaccaguacaaggaccugugccacaugcacaccgggaucgucguggagaagaagaagcgcggcgggaaggaggagaucacgccccacugcgcccucauggacugcaucauguucgacgccgccgucuccggcgggcugaacaccagcgugcugcgggccgugcucccgcgcgacauggucuuccggaccuccacgccccgcguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5629 - RNA, 2092 nt, Artificial Sequence
  mRNA product Design2 comprising derived and/or modified sequence from Lassa virus__AIT17379__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccagcgacgaccugcucauccuggccgccgaccuggagaagcucaagagcaaggugacccggaccgagcgcccccuguccgccgggguguacaugggcaaccugagcucccagcagcucgaccagcggcgcgcgcugcugaacaugaucgggaugagcuccggcaaccggggcgcccaggccgggcgcgacggcgucgugcgggugugggacgucaagaacgccgagcuccugaacaaccaguucgggacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacauggucgacaccaagaaguccagccucaacaucagcggcuacaacuucucccugggcgccgcggugaaggccggggccugcaugcuggacggcgggaacaugcucgagacgaucaaggugagcccccagaccauggacggcauccugaaguccauccugaaggucaagaaggcccucggcauguucaucagcgacaccccgggggagcggaaccccuacgagaacauccuguacaagaucugccuguccggcgacggguggcccuacaucgccagccgcaccuccaucacgggccgggcgugggagaacaccgugguggaccucgagagcgacgggaagccccagaaggccggcuccaacaacagcaacaagucccugcagagcgccggcuucgccgccgggcugaccuacucccagcucaugacccugaaggacgcgaugcugcagcuggacccgaacgccaagacguggauggacaucgagggccgccccgaggaccccgucgagaucgcccucuaccagcccagcuccgggugcuacauccacuucuuccgggagccgaccgaccugaagcaguucaagcaggacgccaaguacagccacggcaucgacgugaccgaccuguucgccgcgcagcccgggcucaccuccgccgugaucgacgcccugccccgcaacauggucaucacgugccagggcagcgacgacauccgcaagcugcucgagagccagggccggaaggacaucaagcugaucgacaucgcccuguccaagaccgacagccgcaaguacgagaacgcggugugggaccaguacaaggaccucugccacaugcacaccgggaucgucguggagaagaagaagcggggcgggaaggaggagaucacgccccacugcgcccugauggacugcaucauguucgacgccgccguguccggcgggcugaacaccagcguccuccgcgccgugcugccgcgggacaugguguuccgcaccuccacgccccgggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5630 - RNA, 2092 nt, Artificial Sequence
  mRNA product Design2 comprising derived and/or modified sequence from Lassa virus__AIT17381__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggcccgggccggccgcgacgggguggugcggaucugggacgucaagaacgccgagcuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccuccaacaccaacagcaacaagucccugcagagcgcgggcuucgccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgucacggaccuguucgccgcccagcccgggcucaccuccgccgugaucgacgcgcugccccgcaacauggugaucacgugccagggcagcgaggacauccgcaagcugcucgagagccagggccggaaggacaucaagcugaucgacaucgcccuguccaagaccgacagccgcaaguacgagaacgccgucugggaccaguacaaggaccucugccacaugcacaccgggguggucguggagaagaagaagaagggcgggaaggaggagaucaccccgcacugcgcccugauggacugcaucauguucgacgcggccguguccggcgggcugaacaccagcguccuccgggccgugcugccccgcgacaugguguuccggaccuccacgccccgcgucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5631 - RNA, 2092 nt, Artificial Sequence
  mRNA product Design2 comprising derived and/or modified sequence from Lassa virus__AIT17389__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcugaaguccacccagcagaaguccgugcuccgcgucgggacccugaccagcgacgaccugcucauccuggccgccgaccuggagaagcucaaguccaaggugacccggaccgagcgcccccugagcgccggcguguacauggggaaccuguccagccagcagcucgaccagcggcgcgcgcugcugaacaugaucggcauguccggcgggaaccagggcgcccggacggggaaggacggcgucgugcgcaucugggacgugaagaacgccgaccuccugaacaaccaguucgggaccaugccgagccugacccucgccugccugaccaagcagggccaggucgaccugaacgacguggugcaggcgcucacggaccugggccugaucuacaccgccaaguaccccaacaccuccgaccucgaccggcugacccagagccaccccauccugaacaugaucgacacguccaagagcagccucaacaucuccggguacaacuucagccugggcgccgccgucaaggccggggcgugcaugcuggacggcggcaacaugcucgagaccaucaaggugagcccccagaccauggacgggauccucaagagcauccugaaggugaagaagucccugggcauguucaucagcgacaccccgggggagcgcaaccccuacgagaacauccuguacaagaucugccuguccggcgacggguggcccuacaucgccagccggacguccaucaccggccgcgccugggagaacaccgucguggaccucgagagcgacggcaagccccagaaggccggguccaacaacagcaacaagucccugcagagcaccggcuucacggccgggcugaccuacucccagcucaugacccugaaggacgcgaugcugcagcuggacccgaacgccaagaccuggauggacaucgagggccggcccgaggaccccguggagaucgcccucuaccagcccagcuccgggugcuacauccacuucuuccgcgagccgacggaccugaagcaguucaagcaggacgccaaguacagccacggcaucgacgucaccgaccuguucgccgcgcagcccggccucaccuccgccgugaucgacacccugccccggaacauggugaucacgugccaggggagcgacgacauccgcaagcugcucgagagccagggccgcaaggacaucaagcugaucgacaucgcccuguccaagaccgacagccggaaguacgagaacgccgucugggaccaguacaaggaccucugccacaugcacaccgggguggucguggagaagaagaagcgcggcgggaaggaggagaucacgccccacugcgcccugauggacugcaucauguucgacgcggccguguccggcggccugaacgucagcgugcuccgggccgugcugccgcgcgacauggucuuccggaccuccacgccccgcguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5632 - RNA, 2092 nt, Artificial Sequence
  mRNA product Design2 comprising derived and/or modified sequence from Lassa virus__AIT17399__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacccugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcuggcccagagccaccccauccugaacaugaucgacaccaagaaguccagccucaacaucagcggcuacaacuucucccugggggccgccgucaaggccggcgcgugcaugcuggacgggggcaacaugcucgagaccaucaaggugacgccccagaccauggacggcauccucaagagcauccugaaggugaagaaggcccuggggauguucaucuccgagaccccgggcgagcgcaaccccuacgagaacauccuguacaagaucugccugagcggggacggcuggcccuacaucgccucccggaccagcaucaccgggcgcgccugggagaacacggucguggaccucgaguccgacggcaagccccagaaggccggcaacaacaacagcaacaagucccugcagagcgcgggguucaccgccggccugaccuacucccagcucaugacccugaaggacagcaugcugcagcuggacccgaacgccaagacguggauggacaucgaggggcggcccgaggaccccguggaggucgcccucuaccagcccuccagcggcugcuacauccacuucuuccgcgagccgaccgaccugaagcaguucaagcaggacgccaaguacucccacgggaucgacgugaccgaccuguucgcgacccagcccggccucacgagcgccgucaucgaggcccugccccggaacauggugaucacgugccagggcuccgacgacauccgcaagcugcucgagagccaggggcgcaaggacaucaagcugaucgacaucgcccugaacaagaccgacagccggaaguacgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaagacccucgcccugcgggcggugcugccgcgcgacaugguguuccggaccagcacccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5633 - RNA, 2092 nt, Artificial Sequence
  mRNA product Design2 comprising derived and/or modified sequence from Lassa virus__AIT17405__NP (opt1)
ggggcgcugccuacggagguggcagccaucuccuucucggcaucaagcuuaccaugagcguguccaaggaggucaagagcuuccuguggacccagucccuccgccgggagcugagcggcuacugcuccaacaucaagcuccagguggugaaggacgcccaggcccugcugcacgggcuggacuucagcgaggucuccaacgugcagcgccucaugcggaagcagaagcgcgacgacagcgaccugaagcggcugcgcgaccucaaccaggcggugaacaaccuggucgagcugaaguccacccagcagaaguccauccuccgggugggcacccugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcccaggggacccagccgggccgcgacggggugguccgggugugggacgugaagaaccccgaccuccugaacaaccaguucggcaccaugcccagccugacccucgcgugccugacgaagcaggggcaggucgaccugaacgacgccgugcucgcccugaccgaccugggccucaucuacaccgccaaguaccccaacuccagcgaccuggaccgccugucccagagccacccgauccucaacaugguggacaucaagaaguccagccugaacaucagcggcuacaacuucucccugggggcggccgucaaggccggcgccugcaugcucgacgggggcaacaugcuggagaccaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgccagccggaccuccaucguggggcgcgcgugggagaacacgaccguggaccuggagagcgacggcaagccccagaaggucggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgcgaaguacucccacggcaucgacgucgccgaccuguucccggcccagcccggccucaccagcgccgugaucgaggcccugccccggaacauggugcugacgugccaggggagcgacgacaucaagcgccuccuggacucccagggccgccgggacaucaagcugaucgacaucgcgcucagcaaggccgacucccgccgguucgagaacgccgucugggaccagugcaaggaccugugccacaugcacaccggggugguggucgagaagaagaagcgcggcgggaaggaggagaucacgccccacugcgcccugauggacugcaucauguacgacgccgcggugagcggcggccucaacaucccggugcugcgggccguccugccccgcgacaugguguuccggaccuccagccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5634 - RNA, 2092 nt, Artificial Sequence
  mRNA product Design2 comprising derived and/or modified sequence from Lassa virus__AIT17409__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucaacaaggccgacucccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgccgcggucagcggcgggcucaacauccccgugcugcgggccgugcugccgcgggacauggucuuccgcaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5635 - RNA, 2092 nt, Artificial Sequence
  mRNA product Design2 comprising derived and/or modified sequence from Lassa virus__AIT17413__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacgcgcccggcgagcgcaaccccuacgagaacauccuguacaagaucugccucagcggggacggcuggccguacaucgccucccggaccagcaucgucgggcgcgccugggagaacaccaccguggaccuggaguccgacggcaagccccagaagaugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5636 - RNA, 2092 nt, Artificial Sequence
  mRNA product Design2 comprising derived and/or modified sequence from Lassa virus__AIT17421__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucagcggcgcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaucaagaaguccagccugaacaucuccggcuacaacuucagccugggcgccgccgugaaggccggggccugcaugcucgacggcgggaacaugcuggagaccaucaaggucacgccccagaccauggacggcauccugaaguccauccucaaggugaagcggagccugggcauguucguguccgacacccccggggagcgcaaccccuacgagaacauccuguacaagaucugccucagcggcgacggguggccguacaucgcgucccggaccagcaucgucggccgcgccugggagaacacgaccguggaccuggaguccgacgggaagccccagaagaugggcagcgccggcuccaacaagagccugcaguccgccggguuccccaccggccucaccuacagccagcugaugacgcugaaggacuccaugaugcagcuggaccccagcgccaagaccuggaucgacaucgaggggcggccggaggaccccguggagaucgcgcucuaccagcccauguccggcugcuacauccacuucuuccgcgagcccaccgaccugaagcaguucaagcaggacgccaaguacagccacgggaucgacgucgccgaccuguucccggcccagcccggccucaccagcgccgugaucgaggcgcugccccggaacaugguccugacgugccagggcuccgacgacaucaagcgccuccuggacagccaggggcgccgggacaucaagcugaucgacaucgcccucuccaaggccgacagccgccgguucgagaacgccgugugggaccagugcaaggaccugugccacaugcacaccggcguggucguggagaagaagaagcgcgggggcaaggaggagaucacgccccacugcgcccugauggacugcaucauguacgacgcggccguguccgggggccucaacaucccgguccugcgggccgugcugccccgcgacaugguguuccggaccagcucccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5637 - RNA, 2092 nt, Artificial Sequence
  mRNA product Design2 comprising derived and/or modified sequence from Lassa virus__AIT17425__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagaagucccuggggauguucgugagcgacacccccggcgagcggaaccccuacgagaacauccuguacaagaucugccucagcggggacggcuggccguacaucgcgucccgcaccagcaucgucgggcgggccugggagaacaccaucguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccgucgagaucgcgcucuaccagcccaugagcgggugcuacauccacuucuuccgggagcccaccgaccugaagcaguucaagcaggacgccaaguacucccacggcaucgacguggccgaccuguucccggcccagcccggccucacgagcgccgucaucgaggcgcugccccgcaacauggugcugaccugccaggggagcgacgacaucaagcggcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5638 - RNA, 2092 nt, Artificial Sequence
  mRNA product Design2 comprising derived and/or modified sequence from Lassa virus__AIT17429__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuacaacuucucccugggggccgccgugaaggccggcgcgugcaugcucgacgggggcaacaugcuggagaccaucaaggucacgccccagaccauggacggcauccucaagagcauccugaaggugaagcggucccuggggauguucgugagcgacgcccccggcgagcgcaaccccuacgagaacauccuguacaagaucugccucuccggggacggcuggccguacaucgccagccggaccuccaucgucgggcgcgccugggagaacaccacgguggaccuggagagcgacggcaagccccagaaggugggcaccgccggguccaacaagagccugcaguccgcgggcuuccccaccgggcucaccuacagccagcugaugacgcugaaggacuccaugaugcagcuggaccccagcgccaagaccuggaucgacaucgagggccggccggaggaccccgucgagaucgcccucuaccagcccauguccgggugcuacauccacuucuuccgcgagcccaccgaccugaagcaguucaagcaggacgccaaguacagccacggcaucgacguggccgaccuguucccggcgcagcccggccucaccuccgccgucaucgaggcccugccccggaacauggugcugacgugccaggggagcgacgacaucaagcgccuccuggacagccagggccgccgggacaucaagcugaucgacaucgcccucuccaaggccgacagccgccgguucgagaacgcggugugggaccagugcaaggaccugugccacaugcacaccggggucgugguggagaagaagaagcgcggcgggaaggaggagaucacgccccacugcgcccugauggacugcaucauguacgacgccgccgucuccggcggccucaacaucccggugcugcgggcggugcugccccgcgacauggucuuccggaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5639 - RNA, 2092 nt, Artificial Sequence
  mRNA product Design2 comprising derived and/or modified sequence from Lassa virus__AIT17431__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuucaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccgccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5640 - RNA, 2092 nt, Artificial Sequence
  mRNA product Design2 comprising derived and/or modified sequence from Lassa virus__AIT17439__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuucaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccgucagcgggugcuacauccacuucuuccgcgagcccacggaccugaagcaguucaagcaggacgccaaguacucccacggcaucgacguggccgaccuguucagcgcccagccgggccucaccagcgccgucaucgaggcgcugccccggaacauggugcugaccugccagggguccgacgacaucaagcgccuccuggacagccagggccgccgggacaucaagcugaucgacaucgcccucuccaaggccgacagccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucuccggcggccucaacauccccguguuccgggccgugcugccgcgcgacauggucuuccggaccagcucccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5641 - RNA, 2092 nt, Artificial Sequence
  mRNA product Design2 comprising derived and/or modified sequence from Lassa virus__AIT17443__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacgcgcccggcgagcgcaaccccuacgagaacauccuguacaagaucugccucagcggggacggcuggccguacaucgccucccggaccagcaucgucgggcgcgccugggagaacaccaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcgcugauggacugcaucauguacgacgccgccgucagcggcggccucaacaucccggugcugcgcgccgugcugccccgggacauggucuuccgcaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5642 - RNA, 2092 nt, Artificial Sequence
  mRNA product Design2 comprising derived and/or modified sequence from Lassa virus__AIT17447__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacgugaccgaccuguucccggcccagcccggccucaccuccgccgucaucgaggcccugccccgcaacauggugcugacgugccaggggagcgacgacaucaagcggcuccuggacagccagggccgccgcgacaucaagcugaucgacaucgcccucuccaaggcggacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgccgccgucuccggcggccucaacaucccggugcugcgcgcggugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5643 - RNA, 2092 nt, Artificial Sequence
  mRNA product Design2 comprising derived and/or modified sequence from Lassa virus__AIT17451__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacguggccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaacaucccggugcugcgcgccgugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5644 - RNA, 2092 nt, Artificial Sequence
  mRNA product Design2 comprising derived and/or modified sequence from Lassa virus__AIT17455__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcuguccaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccagcgccgugaucgaggcgcugccccggaacauggugcugaccugccagggguccgacgacaucaagcgccuccuggacagccagggccgccgggacaucaagcugaucgacaucgcccucuccaaggccgacagccgccgguucgagaacgccgucugggaccagugcaaggaccugugccacaugcacaccggggugguggucgagaagaagaagcgcggcgggaaggaggagaucacgccccacugcgcccugauggacugcaucauguacgacgcggccguguccggcggccucaacaucccggugcugcgggccguccugccccgcgacaugguguuccggaccagcucccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5645 - RNA, 2092 nt, Artificial Sequence
  mRNA product Design2 comprising derived and/or modified sequence from Lassa virus__AIT17459__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccgucagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5646 - RNA, 2092 nt, Artificial Sequence
  mRNA product Design2 comprising derived and/or modified sequence from Lassa virus__AIT17463__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcacaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaguccacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaccaugguggacacgaagaaguccagccugaacaucagcggcuucaacuucucccugggcgccgccgugaaggccggggccugcaugcucgacggcgggaacaugcuggagaccaucaaggucacgccccagaccauggacggcauccucaagagcauccugaaggugaagaagucccugggcauguucgugagcgacacccccggggagcggaaccccuacgagaacauccuguacaagaucugccucuccggcgacggguggccguacaucgcgagccgcaccuccaucgucggccgggccugggagaacaccaucguggaccuggagaccgacgggaagccccagaaggugggcacggccggcagcucccgcagccugcaguccgccggguuccccaccggccucaccuacagccagcugaugacccugaaggacuccaugaugcagcuggaccccagcgccaagacguggaucgacaucgaggggcggccggaggaccccgucgagaucgcgcucuaccagcccauguccggcugcuacauccacuucuuccgcgagcccaccgaccugaagcaguucaagcaggacgccaaguacagccacgggaucgacguggccgaccuguucccggcccagcccggccucaccagcgccgucaucgaggcgcugccccggaacauggugcugaccugccagggcuccgacgacaucaagaagcuccuggacagccaggggcgccgcgacaucaagcugaucgacaucgcccucuccaaggccgacagccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgcggccgucuccgggggccucaacaucccggugcugcgggccgugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5647 - RNA, 2092 nt, Artificial Sequence
  mRNA product Design2 comprising derived and/or modified sequence from Lassa virus__AIT17467__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcacccaggggacccagccgggccgcgacgggguggugcgggucugggacgugaagaaccccgaccuccugaacaaccaguucggcaccaugcccucccugacgcucgcgugccugaccaagcagggccagguggaccugaacgacgccguccucgcccugaccgaccuggggcucaucuacaccgccaaguaccccaacagcuccgaccuggaccgccugagccagagccacccgauccucaacaugguggacacgaagaaguccagccugaacaucuccggcuacaacuucagccugggggcggccgugaaggccggcgccugcaugcucgacgggggcaacaugcuggagaccaucaaggucacgccccagaccauggacggcauccugaaguccauccucaaggugaagaagucccuggggauguucgugagcgacacccccggcgagcggaaccccuacgagaacauccuguacaagaucugccucagcggggacggcuggccguacaucgccucccgcaccagcaucgucgggcgggcgugggagaacaccaccguggaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacguggccgaccuguucccggcccagcccggccucaccagcgccgucaucgaggcccugccccgcaacauggugcugaccugccaggggagcgacgacaucaagcggcuccuggacucccagggccgccgcgacaucaagcugaucgacaucagccucuccaaggcggacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgccgucuccggcggccucaacaucccggugcugcgcgcggugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5648 - RNA, 2092 nt, Artificial Sequence
  mRNA product Design2 comprising derived and/or modified sequence from Lassa virus__AIT17471__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccacggggagcaacaagucccugcagagcgccggcuuccccaccgggcucaccuacucccagcugaugacccugaaggacagcaugaugcagcuggaccccuccgccaagacguggaucgacaucgagggccggccggaggaccccguggagaucgcccucuaccagcccaugagcgggugcuacauccacuucuuccgcgagcccaccgaccugaagcaguucaagcaggacgcgaaguacucccacggcaucgacgucgccgaccuguucccggcccagcccggccucaccagcgccgugaucgaggcccugccccggaacaugguccugaccugccaggggagcgacgacaucaagaagcuccuggacucccagggccgccgcgacaucaagcugaucgacaucgcgcucagcaaggccgacucccggaaguucgagaacguggugugggaccagugcaaggaccugugccacaugcacacgggggucgugguggagaagaagaagcgcggcgggaaggaggagaucacgccccacugcgcccugauggacugcaucauguacgacgccgccgucagcggcggccucaacaucccggugcugcgggcggugcugccccgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5649 - RNA, 2092 nt, Artificial Sequence
  mRNA product Design2 comprising derived and/or modified sequence from Lassa virus__AIT17475__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcgcccagcagcucgagcagcgccgggcgcugcuguccaugaucgggauggugggcggcgcccaggggacgcagccgggccgcgacggggugguccgggugugggacgugaagaaccccgaccuccugaacaaccaguucggcaccaugcccagccugacccucgccugccugaccaagcaggggcaggucgaccugaacgacacggugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccaucuccgggugcuacauccacuucuuccgcgagcccacggaccugaagcaguucaagcaggacgccaaguacagccacggcaucgacgucaccgaccuguucccggcccagcccggccucaccagcgccgugaucgaggcccugccccggaacauggugcugaccugccagggguccgacgacaucaagcgccuccuggacagccagggccgccgggacaucaagaucaucgacaucgcgcuguccaaggccgacagccgccgguucgagaacgccgucugggaccagugcaaggaccucugccacaugcacacgggggugguggucgagaagaagaagcgcggcgggaaggaggagaucacgccccacugcgcccugauggacugcaucauguacgacgccgcgguguccggcggccugaacaucccggugcuccgggccguccugccccgcgacaugguguuccggaccagcucccccaaggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5650 - RNA, 2092 nt, Artificial Sequence
  mRNA product Design2 comprising derived and/or modified sequence from Lassa virus__AIT17479__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccgggugggcacgcugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugucccagagccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccuccgccgugaucgaggcgcugccccggaacauggugcugaccugccaggggagcgacgacaucaagaagcuccuggacagccagggccgcaaggacaucaagcugaucgacaucgcccucuccaaggucgacagccgccgguucgagaacgccgugugggaccagugcaaggaccugugccacaugcacaccgggguggucguggagaagaagaagcgcggcgggaaggaggagaucacgccccacugcgcccugauggacugcaucauguacgacgccgcgguguccggcggccucaacaucccgguccugcgggccgugcugccccgcgacaugguguuccggaccagcucccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5651 - RNA, 2092 nt, Artificial Sequence
  mRNA product Design2 comprising derived and/or modified sequence from Lassa virus__AIT17491__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacgcugaccagcgacgaccugcucacccuggccgccgaccuggagaagcucaaguccaaggugauccgcaccgagcggccccugagcuccggcgucuacauggggaaccugagcacgcagcagcucgagcagcgccgggcccugcuguccaugaucggcauggugggcggggcgcgcggcacccagccggggcgggacggcgugguccgcgugugggacgugaagaaccccgaccuccugaacaaccaguucgggaccaugcccagccugacccucgccugccugacgaagcagggccaggucgaccugaacgacguggugcucgcccugaccgaccugggccucaucuacaccgccaaguaccccaacuccagcgaccuggaccggcugucccagagccacccgauccucaacauggucgacaccaagaaguccagccugaacaucagcggguacaacuucucccugggcgcggccgugaaggccggggccugcaugcucgacggcggcaacaugcuggagacgaucaaggugacgccccagaccauggacgggauccucaagagcauccugaaggucaagaagucccugggcauguucgugagcgacacccccggggagcgcaaccccuacgagaacauccuguacaagaucugccucuccggcgacggguggccguacaucgccagccggaccuccaucgugggccgcgcgugggagaacaccaccgucgaccuggagagcgacggcaagccccagaaggugggggccgccggcuccaacaagagccugcaguccgccggguuccccaccggccucacguacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccaccgaccugaagcaguucaagcaggacgccaaguacagccacggcaucgacgugacggaccuguucuccgcccagccggggcucaccagcgccgugaucgaggcccugccccggaacaugguccugaccugccagggcagcgacgacaucaagcgccuccuggacucccaggggcgccgggacaucaagcugaucgacaucgcgcucagcaaggccgacucccgccgguucgagaacgccgugugggaccagugcaaggaccugugccacaugcacaccggcguggucguggagaagaagaagcgcgggggcaaggaggagaucacgccccacugcgcccugauggacugcaucauguacgacgccgcggugagcggcgggcucaacauccccguccugcgggccgugcugccgcgcgacaugguguuccggaccuccagccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5652 - RNA, 2092 nt, Artificial Sequence
  mRNA product Design2 comprising derived and/or modified sequence from Lassa virus__AIT17495__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcagagcgcccagccggggcgcgacggcguggugcgggucugggacgugaagaaccccgaccuccugaacaaccaguucgggaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuucaacuucagccugggcgccgccgugaaggccggggcgugcaugcucgacggcgggaacaugcuggagaccaucaaggucacgccccagaccauggacggcauccugaaguccauccucaaggugaagcggagccugggcauguucguguccgacgcccccggggagcgcaaccccuacgagaacauccuguacaagaucugccucagcggcgacggguggccguacaucgccucccggaccagcaucgucggccgcgccugggagaacaccacgguggaccuggaguccgacgggaagccccagaaggugggcaccgccggcagcaacaagucccugcagagcgcgggguuccccaccggccucaccuacucccagcugaugacgcugaaggacagcaugaugcagcuggaccccuccgccaagaccuggaucgacaucgaggggcggccggaggaccccgucgagaucgcccucuaccagcccaugagcggcugcuacauccacuucuuccgcgagcccaccgaccugaagcaguucaagcaggacgccaaguacucccacgggaucgacguggccgaccuguucccggcgcagcccggccucaccagcgccgucaucgaggcccugccccggaacauggugcugacgugccagggcagcgacgacaucaagaagcuccuggacucccaggggcgccgcgacaucaagcugaucgacaucgcccucagcaaggccgacucccggcgcuucgagaacgcggugugggaccagugcaaggaccugugccacaugcacaccggcgucgugguggagaagaagaagcgcgggggcaaggaggagaucacgccccacugcgcccugauggacugcaucauguacgacgccgccgucagcgggggccucaacaucccggugcugcgggcggugcugccccgggacauggucuuccgcaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5653 - RNA, 2092 nt, Artificial Sequence
  mRNA product Design2 comprising derived and/or modified sequence from Lassa virus__AIT17499__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaucaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcgccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacgugaagcgccuccuggacucccagggccgccgggacaucaagcugaucgacaucgcccucagcaaggccgacucccgccgguucgagaacgccgucugggaccagugcaaggaccugugccacaugcacaccggggugguggucgagaagaagaagcgcggcgggaaggaggagaucacgccccacugcgcgcugauggacugcaucauguacgacgccgccgugagcggcggccucaacaucccggugcugcgggccguccugccccgcgacaugguguuccggaccuccagccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5654 - RNA, 2092 nt, Artificial Sequence
  mRNA product Design2 comprising derived and/or modified sequence from Lassa virus__AIT17503__NP (opt1)
ggggcgcugccuacggagguggcagccaucuccuucucggcaucaagcuuaccaugagcuccagcaaggaggugaaguccuuccuguggacccagagccuccgccgggagcuguccggcuacugcagcuccaucaagcugcaggucgugaaggacgcccaggcccuccugcacgggcuggacuucagcgagguguccaacguccagcgccucaugcggaagcagaagcgcgacgacagcgaccugaagcggcugcgcgaccucaaccaggcggugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugagccagucccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacgagcgccgucaucgaggcgcugccccgcaacauggugcugaccugccagggguccgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5655 - RNA, 2092 nt, Artificial Sequence
  mRNA product Design2 comprising derived and/or modified sequence from Lassa virus__AIT17507__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccaucgacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccgucgagaucgcgcuguaccagcccauguccgggugcuacauccacuucuuccgggagcccacggaccugaagcaguucaagcaggacgccaaguacagccacggcaucgacguggccgaccucuucccggcccagcccggccugaccuccgccgucaucgaggcgcugccccgcaacauggugcugaccugccaggggagcgacgacaucaagcggcuccuggacagccagggccgccgcgacaucaagcucaucgacaucgcccuguccaagguggacagccggcgcuucgagaacgccgucugggaccagugcaaggaccugugccacaugcacaccggggugguggucgagaagaagaagcggggcgggaaggaggagaucacgccccacugcgcccucauggacugcaucauguacgacgccgcgguguccggcggccugaacaucccggugcugcgcgccguccucccccgggacaugguguuccgcaccagcucccccaaggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5656 - RNA, 2092 nt, Artificial Sequence
  mRNA product Design2 comprising derived and/or modified sequence from Lassa virus__AIT17511__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccaucgacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaaggccgacagccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgccgcggucuccggcgggcucaacauccccgugcugcgggccgugcugccgcgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5657 - RNA, 2092 nt, Artificial Sequence
  mRNA product Design2 comprising derived and/or modified sequence from Lassa virus__AIT17515__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcgccgccgggagcuccaagagccugcaguccgccggcuuccccaccgggcucacguacagccagcugaugacccugaaggacuccaugaugcagcuggaccccagcgcgaagaccuggaucgacaucgagggccggccggaggaccccgucgagaucgcccucuaccagcccguguccgggugcuacauccacuucuuccgcgagcccaccgaccugaagcaguucaagcaggacgccaaguacagccacggcaucgacgucgccgaccuguucccggcccagcccggccucacgagcgcggugaucgaggcccugccccggaacauggugcugaccugccagggguccgacgacaucaagcgccuccuggacagccagggccgccgggacaucaagcugaucgacaucgcccucuccaaggccgacagccgccgguucgagaacgccgucugggaccagugcaaggaccugugccacaugcacaccggggugguggucgagaagaagaagcgcggcgggaaggaggagaucacgccccacugcgcgcugauggacugcaucauguacgacgccgccguguccggcggccucaacaucccggugcugcgggccguccugccccgcgacaugguguuccggaccagcucccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5658 - RNA, 2092 nt, Artificial Sequence
  mRNA product Design2 comprising derived and/or modified sequence from Lassa virus__AIT17519__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuucaacuucucccugggggccgccgugaaggccggcgcgugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgccagccggaccuccaucgucgggcgcgccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgcgaagaccuggaucgacaucgagggccggccggaggaccccgucgagaucgcccucuaccagcccauguccgggugcuacauccacuucuuccgcgagcccaccgaccugaagcaguucaagcaggacgccaaguacagccacggcaucgacguggccgaccuguucccggcccagcccggccucacguccgcggucaucgaggcccugccccggaacauggugcugaccugccaggggagcgacgacaucaagcgccuccuggacagccagggccgccgggacaucaagcugaucgacaucgcccucuccaaggccgacagccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucuccggcggccucaacaucccggugcugcgggccgugcugccccgcgacauggucuuccggaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5659 - RNA, 2092 nt, Artificial Sequence
  mRNA product Design2 comprising derived and/or modified sequence from Lassa virus__AIT17525__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacccugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccggcugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcgcagccuggggauguucgucuccgacacccccggcgagcggaaccccuacgagaacauccuguacaagaucugccucagcggggacggcuggccguacaucgcgucccgcaccagcaucguggggcgggccugggagaacaccaccguggaccuggaguccgacggcaagccccagaaggucggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccacggaccugaagcaguucaagcaggacgccaaguacucccacggcaucgacgucgccgaccuguucccgacccagcccggccucaccagcgccgugaucgaggcccugccccgcaacauggugcugaccugccaggggagcgacgacaucaagcgccuccuggacucccagggccggcgcgacaucaagcugaucgacaucgcgcucagcaaggccgacucccggaaguucgagaacgccgucugggaccagugcaaggaccugugccacaugcacacgggggugguggucgagaagaagaagcgcggcgggaaggaggagaucacgccccacugcgcccugauggacugcaucauguacgacgccgcggugagcggcggccucaacaucccggugcugcgggccguccugccccgcgacaugguguuccggaccuccagccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5660 - RNA, 2092 nt, Artificial Sequence
  mRNA product Design2 comprising derived and/or modified sequence from Lassa virus__AIT17533__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgaggugaacaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcacccaggggacccagccgggccgcgacggggucgugcgggugugggacgucaagaaccccgaccuccugaacaaccaguucggcaccaugcccucccugacgcucgccugccugaccaagcagggccagguggaccugaacgacgccgugcucgcccugaccgaccuggggcucaucuacaccgcgaaguaccccaacagcuccgaccuggaccgccugagccagucccacccgauccucaacauggucgacacgaagaaguccagccugaacaucagcggcuacaacuucagccugggggccgccgugaaggccggcgccugcaugcucgacgggggcaacaugcuggagaccaucaaggugacgccccagaccauggacggcauccugaaguccauccucaaggucaagcggagccuggggauguucguguccgacacccccggcgagcgcaaccccuacgagaacauccuguacaagaucugccucagcggggacggcuggccguacaucgcgucccggaccagcaucguggggcgcgccugggagaacaccaccgucgaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccggccggaggaccccguggagaucgcgcucuaccagcccaugagcgggugcuacauccacuucuuccgcgagcccaccgaccugaagcaguucaagcaggacgccaaguacucccacggcaucgacgucgccgaccuguucccggcccagcccggccucaccagcgccgugaucgaggcgcugccccggaacaugguccugaccugccagggguccgacgacaucaagaagcuccuggacagccagggccgccgcgacaucaagcugaucgacaucagccucuccaagaucgacagccggaaguucgagaacgccgugugggaccagugcaaggaccugugccacaugcacacggggguggucguggagaagaagaagcgcggcgggaaggaggagaucacgccccacugcgcccugauggacugcaucauguucgacgccgccguguccggcggccucaacaucccgguccugcgggcggugcugccccgcgacaugguguuccggaccagcucccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5661 - RNA, 2092 nt, Artificial Sequence
  mRNA product Design2 comprising derived and/or modified sequence from Lassa virus__AIT17539__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacgcugaccagcgacgaccugcucauccuggccgccgaccuggagaagcucaaguccaaggugauccgcaccgagcggccccugagcuccggcgucuacauggggaaccugagcacccagcagcucgagcagcgcaaggcccugcuguccaugaucggcauggugggcggggcgcagggcacgcagccggggcgggacggcgugguccgcgugugggacgugaagaaccccgaccuccugaacaaccaguucgggaccaugcccagccugacccucgccugccugaccaagcagggccaggucgaccugaacgacgccgugcucgcccugacggaccugggccucaucuacaccgcgaaguaccccaacuccagcgaccuggaccggcugucccagagccacccgauccucaacaugguggacaccaagaaguccagccugaacaucagcggguacaacuucucccugggcgccgccgucaaggccggggccugcaugcucgacggcggcaacaugcuggagaccaucaaggugacgccccagaccauggacgggauccucaagagcauccugaaggugaagcgcucccugggcauguucgucagcgacacccccggggagcggaaccccuacgagaacauccuguacaagaucugccucuccggcgacggguggccguacaucgcgagccgcaccuccaucgugggccgggccugggagaacacgaccguggaccuggagagcgacggcaagccccagaaggucggguccgccggcagcaacaagucccugcagagcgccggguuccccaccggccucaccuacucccagcugaugacgcugaaggacagcaugaugcagcuggaccccuccgccaagaccuggaucgacaucgaggggcgcccggaggaccccguggagaucgcgcucuaccagcccaugagcggcugcuacauccacuucuuccgggagcccaccgaccugaagcaguucaagcaggacgccaaguacucccacggcaucgacgucaccgaccuguucagcgcccagccggggcucacgagcgccgugaucgaggcccugccccgcaacauggugcugaccugccagggcuccgacgacaucaagaagcuccuggacagccaggggcggcgcgacaucaagcugaucgacaucucccucggcaaggcggacagccgccgguucgagaacgccgucugggaccagugcaaggaccugugccacaugcacaccggggugguggucgagaagaagaagcgcggcggcaaggaggagaucacgccccacugcgcccugauggacugcaucauguucgacgccgccguguccgggggccucaacauccccauccugcgggcggugcugccgcgcgacauggucuuccggaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5662 - RNA, 2092 nt, Artificial Sequence
  mRNA product Design2 comprising derived and/or modified sequence from Lassa virus__AIT17541__NP (opt1)
ggggcgcugccuacggagguggcagccaucuccuucucggcaucaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugagcuccgacgaccugcucacccuggccgccgaccuggagaagcucaagagcaaggugauccgcaccgagcggccccuguccagcggcgucuacauggggaaccuguccagccagcagcucgaccagcgccgggcccugcugaacaugaucggcaugaccuccgaccgccagggcgcgagcacggggcgggacggcaucgugcgcgugugggacgucaagaacgccgagcuccugaacaaccaguucgggaccgugccgucccugacccucgccugccugaccaagcagggccagguggaccugaacgacgccguccaggcgcucacggaccuggggcugaucuacaccgccaaguaccccaacagcagcgaccucgaccggcugucccagagccaccccauccugaacaugaucgacaccaagaaguccagccucaacaucuccggcuacaacuucagccugggcgccgccgugaaggccggggcgugcaugcuggacggcgggaacaugcucgagaccaucaaggugagcccccagacgauggacggcauccucaagagcauccugaaggucaagcgcucccugggcauguucgugagcgacaucccgggggagcggaaccccuacgagaacauccuguacaagaucugccuguccggcgacggguggcccuacaucgccagccgcaccuccaucaccggccgggccugggagaacaccaucguggaccucgagagcgacuccaagccccagaagccggggaacagcggcuccaaccgcagccugcaguccgccggcuuccccgccgggcugacguacagccagcucaugacccugaaggacagcaugcugcagcuggaccccaacgcgaagaccuggauggacaucgagggccggcccgacgacccggucgagaucgcccucuaccagcccuccagcgggugcuacauccacuucuuccgcgagcccaccgaccugaagcaguucaagcaggacgccaaguacucccacggcaucgacgugggggaccuguucgccgcccagcccggccucacgagcgcggugaucgaggcccugccgcgcaacauggucaucacgugccagggcuccgaggacaucaagaagcugcucgagagccaggggcggaaggacaucaagcugguggacaucuccaugagcaagcccgacucccgcaaguucgagaacgccgucugggaccaguacaaggaccugugccacaugcacaccggcaucgugguggagaagaagaagcgcgggggcaaggaggagaucacgccccacugcgcccucauggacugcaucauguucgacgccgcggucgucgggggccuggacgcccggauccugcgggccgugcucccccgcgacaugguguuccggaccagcaccccgaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5663 - RNA, 2092 nt, Artificial Sequence
  mRNA product Design2 comprising derived and/or modified sequence from Lassa virus__AIT17545__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccgggugggcacgcugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugucccagagccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgcgagccgcaccuccaucguggggcgggccugggagaacaccaccguggaccuggagagcgacggcaagccccagaaggucggcaucgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccguggagaucgcgcucuaccagcccauguccgggugcuacauccacuucuuccgggagcccaccgaccugaagcaguucaagcaggacgccaaguacagccacggcaucgacgucgccgaccuguucuccgcccagccgggccucacgagcgccgugaucgaggcgcugccccgcaacauggugcugaccugccaggggagcgacgacaucaagcggcuccuggacucccagggccgccgcgacaucaagcugaucgacaucgcccucagcaaggccgacucccggaaguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucgacauccccgugcugcgggccguccugccgcgcgacaugguguuccggaccuccagccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5664 - RNA, 2092 nt, Artificial Sequence
  mRNA product Design2 comprising derived and/or modified sequence from Lassa virus__AIT17549__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgucgugcucgcccugaccgaccuggggcucaucuacaccgccaaguaccccaacuccagcgaccuggaccgccugucccagagccacccgauccucaacaugguggacaccaagaaguccagccugaacaucagcggcuacaacuucucccugggggcggccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgccagccgcaccuccaucguggggcgggcgugggagaacaccaccguggaccuggagagcgacggcaagccccagaaggucggcaccgugggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcccucuaccagcccauguccgggugcuacauccacuucuuccgggagcccacggaccugaagcaguucaagcaggacgccaaguacagccacggcaucgacguggcggaccuguucccggcccagcccggccucaccuccgccgugaucgaggcccugccccgcaacaugguccugaccugccaggggagcgacgacaucaagaagcuccuggacagccagggccggcgcgacaucaagcugaucgacaucgcccucuccaaggcggacagccgcaaguucgagaacgccgugugggaccagugcaaggaccugugccacaugcacaccgggguggucguggagaagaagaagcggggcgggaaggaggagaucacgccccacugcgcccugauggacugcaucauguacgacgccgccguguccggcggccucaacaucccgguccugcgcgcggugcugccccgggacaugguguuccgcaccagcucccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5665 - RNA, 2092 nt, Artificial Sequence
  mRNA product Design2 comprising derived and/or modified sequence from Lassa virus__AIT17553__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccaugagcgggugcuacauccacuucuuccgcgagcccacggaccugaagcaguucaagcaggacgccaaguacucccacggcaucgacgucgccgaccuguucccggcccagcccggccucaccagcgccgugaucgaggcgcugccccggaacaugguccugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcccugauggacugcaucauguacgacgcggccgugagcggcggccucaacaucccgguccugcgcgccgugcugccccgggacaugguguuccgcaccuccagccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5666 - RNA, 2092 nt, Artificial Sequence
  mRNA product Design2 comprising derived and/or modified sequence from Lassa virus__AIT17561__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccaucgacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgucggguccaacaagagccugcaguccgccggcuuccccacggggcucaccuacagccagcugaugacccugaaggacuccaugaugcagcuggaccccagcgccaagaccuggaucgacaucgagggccgcccggaggaccccguggagaucgcccucuaccagcccauguccgggugcuacauccacuucuuccgggagcccacggaccugaagcaguucaagcaggacgcgaaguacagccacggcaucgacgucgccgaccuguucccggcccagcccggccucaccuccgccgugaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgucugggaccagugcaaggaccugugccacaugcacaccggggugguggucgagaagaagcggcgcggcgggaaggaggagaucacgccccacugcgcccugauggacugcaucauguacgacgccgcgguguccggcggccucaacaucccggugcugcgggccguccugccccgcgacaugguguuccggaccagcucccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5667 - RNA, 2092 nt, Artificial Sequence
  mRNA product Design2 comprising derived and/or modified sequence from Lassa virus__AIT17565__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaaggccgacucccgcaaguucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5668 - RNA, 2092 nt, Artificial Sequence
  mRNA product Design2 comprising derived and/or modified sequence from Lassa virus__AIT17569__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacguggccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaaccugccggugcugcgcgccgugcucccccgggacauggucuuccgcaccagcucccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5669 - RNA, 2092 nt, Artificial Sequence
  mRNA product Design2 comprising derived and/or modified sequence from Lassa virus__AIT17573__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacaucgccgaccuguucccggcccagcccggccucaccuccgccgugaucgaggcgcugccccgcaacaugguccugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgcggccguguccggcggccucaacaucccgguccugcgcgccgugcugccccgggacaugguguuccgcaccagcucccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5670 - RNA, 2092 nt, Artificial Sequence
  mRNA product Design2 comprising derived and/or modified sequence from Lassa virus__AIT17577__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgccgggcgcgccugggagaacaccaccgucgaccuggaguccgacggcaagccccagaaggugggcgccgccgggagcaacaagucccugcagagcgcgggcuuccccaccgggcucacguacucccagcugaugacccugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcgcagcccggccucacgagcgccgugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgcggugugggaccagugccgcgaccugugccacaugcacaccgggguggucguggagaagaagaagcggggcgggaaggaggagaucacgccccacugcgcccugauggacugcaucauguacgacgccgccgugagcggcggccucaacaucccgguccugcgcgcggugcugccccgggacaugguguuccgcaccuccagccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5671 - RNA, 2092 nt, Artificial Sequence
  mRNA product Design2 comprising derived and/or modified sequence from Lassa virus__AIT17581__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcgcccagcagcucgagcagcgccggacgcugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacguggugcucgcccugaccgaccugggccucaucuacaccgccaaguaccccaacagcuccgaccuggaccgccugagccagagccacccgauccucuccauggucgacaccaagaaguccagccugaacaucagcggcuacaacuucucccugggggcggccgugaaggccggcgccugcaugcucgacgggggcaacaugcuggagacgaucaaggugacgccccagaccauggacggcauccucaagagcauccugaaggucaagaagucccuggggauguucgugagcgacacccccggcgagcggaaccccuacgagaacauccuguacaagaucugccucuccggggacggcuggccguacaucgccagccgcaccuccaucguggggcgggcgugggagaacaccaccgucgaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcccucuaccagcccauguccgggugcuacauccacuucuuccgggagcccacggaccugaagcaguucaagcaggacgcgaaguacagccacggcaucgacgugaccgaccuguucccggcccagcccggccucaccagcgccgugaucgaggcccugccccgcaacaugguccugaccugccagggguccgacgacaucaagcggcuccuggacagccagggccgccgcgacaucaagcugaucgacaucgcccucuccaaggcggacagccggcgcuucgagaacgccgugugggaccagugcaaggaccugugccacaugcacacggggguggucguggagaagaagaagcggggcgggaaggaggagaucacgccccacugcgcccugauggacugcaucauguacgacgccgccguguccggcggccucaacaucccgguccugcgcgcggugcugccccgggacaugguguuccgcaccagcucccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5672 - RNA, 2092 nt, Artificial Sequence
  mRNA product Design2 comprising derived and/or modified sequence from Lassa virus__AIT17589__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuacaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccaccgggagcaacaagucccugcagagcgccggcuuccccacggggcucaccuacucccagcugaugacccugaaggacagcaugaugcagcuggaccccuccgccaagaccuggaucgacaucgagggccggccggaggaccccgucgagaucgcgcucuaccagcccaugagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagaagcuccuggacucccagggccgccgcgacaucaagcugaucgacaucgcccucagcaaggccgacucccggaaguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5673 - RNA, 2092 nt, Artificial Sequence
  mRNA product Design2 comprising derived and/or modified sequence from Lassa virus__AIT17593__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacggcgaccugaagcggcugcgcgaccucaaccaggccgugaacaaccugguggagcugaaguccacccagcagaaguccauccuccgggucgggacgcugaccagcgacgaccugcucacccuggccgccgaccuggagaagcucaagagcaaggugauccgcaccgagcggccccuguccagcggcguguacauggggaaccuguccagccagcagcucgagcagcgccgggcccugcugaacaugaucggcauggucggcggggcgcagggcacgcagccggggcgcgacggcguggugcgggucugggacgugaagaaccccgaccuccugaacaaccaguucgggaccaugcccucccugacccucgccugccugaccaagcagggccagguggaccugaacgacgccguccucgcccugacggaccugggccucaucuacaccgcgaaguaccccaacagcuccgaccuggaccgccugagccagagccacccgauccucaacaugguggacaccaagaaguccagccugaacaucuccggguacaacuucagccugggcgccgccgugaaggccggggccugcaugcucgacggcggcaacaugcuggagaccaucaaggucacgccccagaccauggacgggauccugaaguccauccucaaggugaagcggagccugggcauguucguguccgacacccccggggagcgcaaccccuacgagaacauccuguacaagaucugccucagcggcgacggguggccguacaucgcgucccggaccagcaucgucggccgcgccugggagaacacgaccguggaccuggaguccgacggcaagccccagaaggugggggccgccggcagcaccaagucccugcagagcgccggguuccccaccggccucacguacucccagcugaugacccugaaggacagcaugaugcagcuggaccccuccgcgaagaccuggaucgacaucgaggggcggccggaggaccccgucgagaucgcccucuaccagcccaugagcggcugcuacauccacuucuuccgcgagcccaccgaccugaagcaguucaagcaggacgccaaguacucccacggcaucgacguggccgaccuguucccggcccagcccgggcucacgagcgcggucaucgaggcccugccccggaacauggugcugaccugccagggcagcgacgacaucaagcgccuccuggacucccaggggcgccgggacaucaagcugaucgacaucgcccucagcaagguggacucccgccgguucgagaacgccgucugggaccagugcaaggaccugugccacaugcacaccggcgugguggucgagaagaagaagcgcgggggcaaggaggagaucacgccccacugcgcccugauggacugcaucauguacgacgcggccgugagcggcgggcucaacaucccggugcugcgggccguccugccccgcgacaugguguuccggaccuccagccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5674 - RNA, 2092 nt, Artificial Sequence
  mRNA product Design2 comprising derived and/or modified sequence from Lassa virus__AIT17605__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagagccacccgauccucaacauggucgacaccaagaaguccagccugaacaucuccggcuacaacuucagccugggggccgccgugaaggccggcgcgugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggccugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgcgaagaccuggaucgacaucgagggccgcccggaggaccccguggagaucgcccucuaccagcccaugagcgggugcuacauccacuucuuccgggagcccacggaccugaagcaguucaagcaggacgccaaguacucccacggcaucgacgucgccgaccuguucagcgcccagccgggccucaccagcgcggugaucgaggcccugccccgcaacaugguccugaccugccagggguccgacgacaucaagcggcuccuggacagccagggccgccgcgacaucaagcugaucgacaucgcccucuccaaggccgacagccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccguguccggcggccucaacauccccguccugcgcgccgugcugccgcgggacaugguguuccgcaccagcucccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5675 - RNA, 2092 nt, Artificial Sequence
  mRNA product Design2 comprising derived and/or modified sequence from Lassa virus__AIT17609__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagagccacccgauccucaacauggucgacaccaagaaguccagccugaacaucuccggcuacaacuucagccugggggccgccgugaaggccggcgcgugcaugcucgacgggggcaacaugcuggagacgaucaaggugacgccccagaccauggacggcauccugaaguccauccucaaggucaagcggagccuggggauguucguguccgacacccccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcgccgccgggagcaacaagucccugcagagcgcgggcuuccccaccgggcucacguacucccagcugaugacccugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcgcagcccggccucacgagcgccgugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgcggugugggaccagugcaaggaccugugccacaugcacaccgggguggucguggagaagaagaagcgcggcgggaaggaggagaucacgccccacugcgcccugauggacugcaucauguacgacgccgccgugagcggcggccucaacaucccgguccugcgggcggugcugccccgcgacaugguguuccggaccuccagccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5676 - RNA, 2092 nt, Artificial Sequence
  mRNA product Design2 comprising derived and/or modified sequence from Lassa virus__AIT17613__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccgucgagaucgcgcucuaccagcccauguccgggugcuacauccacuucuuccgcgagcccacggaccugaagcaguucaagcaggacgccaaguacagccacggcaucgacguggccgaccuguucccggcccagcccggccucaccuccgccgucaucgaggcgcugccccggaacauggugcugaccugccaggggagcgacgacaucaagcgccuccuggacagccagggccgccgggacaucaagcugaucgacaucgcccucuccaagaccgacagccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucuccggcggccucaacaucccggugcugcgggccgugcugccccgcgacauggucuuccggaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5677 - RNA, 2092 nt, Artificial Sequence
  mRNA product Design2 comprising derived and/or modified sequence from Lassa virus__AIT17617__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuucaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucagcggcggccucaacaucccggugcugcgggccgugcugccccgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5678 - RNA, 2092 nt, Artificial Sequence
  mRNA product Design2 comprising derived and/or modified sequence from Lassa virus__AIT17621__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugaccaacguccagcgccucaugcggaagcagaagcgcgacgacagcgaccugaagcggcugcgcgaccucaaccaggccgugaacaaccugguggagcugaaguccacgcagcagaaguccauccuccgggucggcacccugaccagcgacgaccugcucacccuggccgccgaccuggagaagcucaagagcaaggugauccgcacggagcggccccuguccagcgggguguacaugggcaaccuguccacccagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacgcucgccugccugaccaagcagggccagguggaccugaacgacgccguccucgcccugaccgaccuggggcucaucuacaccgcgaaguaccccaacuccagcgaccuggaccgccugucccagagccacccgauccucaacaugguggacacgaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaucgccggguccaacaagagccugcaguccgccggcuuccccacggggcucaccuacagccagcugaugacccugaaggacuccaugaugcagcuggaccccagcgccaagaccuggaucgacaucgagggccggccggaggaccccgucgagaucgcgcucuaccagcccauguccgggugcuacauccacuucuuccgcgagcccacggaccugaagcaguucaagcaggacgccaaguacagccacggcaucgacguggccgaccuguucccggcccagcccggccucaccuccgccgucaucgaggcgcugccccggaacauggugcugaccugccaggggagcgacgacaucaagcgccuccuggacagccagggccgccgggacaucaagcugaucgacaucgcccucuccaaggccgacagccgcaaguucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5679 - RNA, 2092 nt, Artificial Sequence
  mRNA product Design2 comprising derived and/or modified sequence from Lassa virus__AIT17625__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacgcugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccggcugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcgcagccuggggauguucgucuccgacacccccggcgagcggaaccccuacgagaacauccuguacaagaucugccucagcggggacggcuggccguacaucgcgucccgcaccagcaucguggggcgggccugggagaacaccaccguggaccuggaguccgacggcaagccccagaaggucggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccacggaccugaagcaguucaagcaggacgccaaguacucccacggcaucgacgucgccgaccuguucccggcccagcccggccucaccagcgccgugaucgaggcgcugccccgcaacauggugcugaccugccaggggagcgacgacaucaagcgccuccuggacucccagggccggcgcgacaucaagcugaucgacaucgcccucagcaaggccgacucccggaaguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucaacaucccggugcugcgggccguccugccccgcgacaugguguuccggaccuccagccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5680 - RNA, 2092 nt, Artificial Sequence
  mRNA product Design2 comprising derived and/or modified sequence from Lassa virus__AIT17627__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcucccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugagccagucccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacacgaccguggaccuggagagcgacggcaagccccagaaggugggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccgucgagaucgcgcucuaccagcccaugagcgggugcuacauccacuucuuccgcgagcccaccgaccugaagcaguucaagcaggacgccaaguacagccacggcaucgacguggccgaccuguucccggcccagcccggccucaccuccgccgucaucgaggcgcugccccggaacauggugcugacgugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5681 - RNA, 2092 nt, Artificial Sequence
  mRNA product Design2 comprising derived and/or modified sequence from Lassa virus__AIT17631__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccgggguggucguggagaagaagaagcgcggcgggaaggaggagaucacgccccacugcgcgcugauggacugcaucauguacgacgccgccgugagcggcggccucaacaucccgguccugcgggccgugcugccccgcgacaugguguuccggaccuccagccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5682 - RNA, 2092 nt, Artificial Sequence
  mRNA product Design2 comprising derived and/or modified sequence from Lassa virus__AIT17635__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacaacgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugaacacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacucccagggccgccgcgacaucaagcugaucgacaucgcccucagcaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5683 - RNA, 2092 nt, Artificial Sequence
  mRNA product Design2 comprising derived and/or modified sequence from Lassa virus__AIT17639__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaucaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacacgaccguggaccuggagagcgacggcaagccccagaaggugggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccgucgagaucgcgcucuaccagcccaugagcgggugcuacauccacuucuuccgcgagcccaccgaccugaagcaguucaagcaggacgccaaguacucccacggcaucgacguggccgaccuguucccggcccagcccggccucaccagcgccgucaucgaggcgcugccccggaacauggugcugacgugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5684 - RNA, 2092 nt, Artificial Sequence
  mRNA product Design2 comprising derived and/or modified sequence from Lassa virus__AIT17643__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuacaacuucucccugggggccgccgugaaggccggcgcgugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgccagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgcgaagaccuggaucgacaucgagggccgcccggaggaccccgucgagaucgcccucuaccagcccauguccgggugcuacauccacuucuuccgggagcccaccgaccugaagcaguucaagcaggacgccaaguacagccacggcaucgacguggccgaccuguucccggcccagcccggccucacguccgcggucaucgaggcccugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcgcugauggacugcaucauguacgacgccgccgucuccggcggccucaacaucccggugcugcgcgccgugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5685 - RNA, 2092 nt, Artificial Sequence
  mRNA product Design2 comprising derived and/or modified sequence from Lassa virus__AIT17651__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcgcccagcagcucgagcagcgccgggcgcugcugaacaugaucgggauggugggcggcgcccaggggacgcagccgggccgcgacggggugguccgggugugggacgugaagaaccccgaccuccugaacaaccaguucggcaccaugcccucccugacccucgccugccugaccaagcaggggcaggucgaccugaacgacguggugcucgcccugacggaccugggccucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagaccaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgcgucccgcaccagcaucguggggcgggccugggagaacacgaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccgucgagaucgcgcucuaccagcccaugagcgggugcuacauccacuucuuccgggagcccaccgaccugaagcaguucaagcaggacgccaaguacucccacggcaucgacgugacggaccuguucagcgcccagccgggccucaccagcgccgugaucgaggcccugccccgcaacaugguccugaccugccagggguccgacgacaucaagcggcuccuggacagccagggccgccgcgacaucaagcugaucgacaucgcgcucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgccgcgguguccggcggccucaacauccccguccugcgcgccgugcugccgcgggacaugguguuccgcaccagcucccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5686 - RNA, 2092 nt, Artificial Sequence
  mRNA product Design2 comprising derived and/or modified sequence from Lassa virus__AIT17655__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagaagccccuguccagcgggguguacaugggcaaccuguccacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccggcugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccggccggaggaccccgucgagaucgcccucuaccagcccauguccgggugcuacauccacuucuuccgcgagcccaccgaccugaagcaguucaagcaggacgcgaaguacagccacggcaucgacguggccgaccuguucccggcccagcccggccucaccuccgccgucaucgaggcccugccccggaacauggugcugaccugccaggggagcgacgacaucaagcgccuccuggacagccagggccggcgcgacaucaagcugaucgacaucgcgcucuccaaggccgacagccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucuccggcggccucaacaucccggugcugcgggccgugcugccccgcgacauggucuuccggaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5687 - RNA, 2092 nt, Artificial Sequence
  mRNA product Design2 comprising derived and/or modified sequence from Lassa virus__AIT17659__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcuguccaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccagcgccgugaucgaggcgcugccccggaacauggugcugaccugccagggguccgacgacaucaagcgccuccuggacagccagggccgccgggacaucaagcugaucgacaucgcccucaacaaggccgacucccgccgguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucaacaucccggugcugcgggccguccugccccgcgacaugguguuccggaccuccagccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5688 - RNA, 2092 nt, Artificial Sequence
  mRNA product Design2 comprising derived and/or modified sequence from Lassa virus__AIT17663__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccgucgagaucgcgcucuaccagcccaugagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5689 - RNA, 2092 nt, Artificial Sequence
  mRNA product Design2 comprising derived and/or modified sequence from Lassa virus__AIT17667__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccaucgacggcauccugaaguccauccucaaggugaagaagucccuggggauguucgugagcgacacccccggcgagcggaaccccuacgagaacauccuguacaagaucugccucagcggggacggcuggccguacaucgcgucccgcaccagcaucgucgggcgggccugggagaacaccaccguggaccuggaguccgacggcaagccccagaaggugggcaccacggggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacgugaccgaccuguucccggcccagcccggccucaccagcgccgucaucgaggcccugccccgcaacauggugcugacgugccaggggagcgaggacaucaagcggcuccuggacucccagggccgccgcgacaucaagcugaucgacaucgcccucagcaaggcggacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgccgccgucagcggcggccucaacaucccggugcugcgcgcggugcugccccgggacauggucuuccgcaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5690 - RNA, 2092 nt, Artificial Sequence
  mRNA product Design2 comprising derived and/or modified sequence from Lassa virus__AIT17671__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacguggugcucgcccugaccgaccugggccucaucuacaccgccaaguaccccaacagcuccgaccuggaccgccugagccagagccacccgauccucaacauggucgacaccaagaaguccagccugaacaucuccggcuacaacuucagccugggggcggccgugaaggccggcgccugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggcgugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccgucgagaucgcccucuaccagcccaugagcgggugcuacauccacuucuuccgggagcccacggaccugaagcaguucaagcaggacgcgaaguacucccacggcaucgacgugaccgaccuguucccggcccagcccggccucaccagcgccgugaucgaggcccugccccgcaacaugguccugaccugccaggggagcgacgacaucaagcggcuccuggacucccagggccgccgcgacaucaagcugaucgacaucgcccucagcaaggcggacucccggcgcuucgagaacgccgugugggaccagugcaaggaccugugccacaugcacacggggguggucguggagaagaagaagcggggcgggaaggaggagaucacgccccacugcgcccugauggacugcaucauguacgacgccgccgugagcggcggccucaacaucccgguccugcgcgcggugcugccccgggacaugguguuccgcaccuccagccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5691 - RNA, 2092 nt, Artificial Sequence
  mRNA product Design2 comprising derived and/or modified sequence from Lassa virus__AIT17675__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacgccgugcucgcccugaccgaccugggccucaucuacaccgcgaaguaccccaacagcuccgaccuggaccgccugagccagagccacccgauccucaacaugguggacaccaagaaguccagccugaacaucuccggcuacaacuucagccugggggccgccgucaaggccggcgccugcaugcucgacgggggcaacaugcuggagacgaucaaggugacgccccagaccauggacggcauccugaaguccauccucaaggugaagaagucccuggggauguucgucagcgacacccccggcgagcggaaccccuacgagaacauccuguacaagaucugccucagcggggacggcuggccguacaucgcgucccgcaccagcaucguggggcgggccugggagaacaccaucguggaccuggaguccgacggcaagccccagaaggucggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccaccgaccugaagcaguucaagcaggacgccaaguacucccacggcaucgacgucgccgaccuguucccggcccagcccggccucacgagcgccgugaucgaggcgcugccccgcaacauggugcugaccugccaggggagcgacgacaucaagcggcuccuggacucccagggccgccgcgacaucaagcugaucgacaucgcccucagcaaggccgacucccggcgcuucgagaacgccgucugggaccagugcaaggaccugugccacaugcacaccggggugguggucgagaagaagaagcggggcgggaaggaggagaucacgccccacugcgcccugauggacugcaucauguacgacgcggccgugagcggcggccucaacaucccggugcugcgcgccguccugccccgggacaugguguuccgcaccuccagccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5692 - RNA, 2092 nt, Artificial Sequence
  mRNA product Design2 comprising derived and/or modified sequence from Lassa virus__AIT17679__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaguccacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaacaugguggacaccaagaaguccagccugaacaucagcggcuacaacuucucccugggcgccgccgugaaggccggggccugcaugcucgacggcgggaacaugcuggagacgaucaaggucacgccccagaccauggacggcauccucaagagcauccugaaggugaagcggucccugggcauguucgugagcgacacccccggggagcgcaaccccuacgagaacauccuguacaagaucugccucuccggcgacggguggccguacaucgcgagccggaccuccaucgucggccgcgccugggagaacaccaccguggaccuggagagcgacgggaagccccagaaggugggcaccgccggcuccaacaagagccugcaguccgccggguuccccacgggccucaccuacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccacggaccugaagcaguucaagcaggacgccaaguacagccacgggaucgacguggccgaccuguucccggcccagcccggccucaccagcgccgucaucgaggcgcugccccggaacauggugcugaccugccagggcuccgacgacaucaagcgccuccuggacagccaggggcgccgggacaucaagcugaucgacaucgcccucuccaaggccgacagccgccgguucgagaacgccgugugggaccagugcaaggaccugugccacaugcacaccggcgucgugguggagaagaagaagcgcgggggcaaggaggagaucacgccccacugcgcccugauggacugcaucauguacgacgcggccgucuccgggggccucaacaucccggugcugcgggccgugcugccccgcgacauggucuuccggaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5693 - RNA, 2092 nt, Artificial Sequence
  mRNA product Design2 comprising derived and/or modified sequence from Lassa virus__AIT17683__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuucaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5694 - RNA, 2092 nt, Artificial Sequence
  mRNA product Design2 comprising derived and/or modified sequence from Lassa virus__AIT17687__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuacaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucagcggcggccucaacaucccggugcugcgggccgugcugccccgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5695 - RNA, 2092 nt, Artificial Sequence
  mRNA product Design2 comprising derived and/or modified sequence from Lassa virus__AIT17695__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgucgugcuggcccugaccgaccucgggcugaucuacaccgccaaguaccccaacuccagcgaccuggaccgccucucccagagccacccgauccugaacaugguggacaccaagaaguccagccugaacaucagcggcuucaacuucucccucggggcggccgucaaggccggcgccugcaugcuggacgggggcaacaugcuggagacgaucaaggugacgccccacaccauggacggcauccucaagagcauccugaaggugaagaagucccuggggauguucgucagcgacacccccggcgagcggaaccccuacgagaacauccucuacaagaucugccuguccggggacggcuggccguacaucgccagccgcaccuccaucguggggcgggcgugggagaacaccaccguggaccuggagagcgacggcaagccccacaaggucggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccguggagaucgcccuguaccagcccauguccgggugcuacauccacuucuuccgggagcccacggaccugaagcaguucaagcaggacgcgaaguacagccacggcaucgacgucgccgaccucuucccggcccagcccggccugaccuccgccgugaucgaggcccugccccgcaacauggugcugaccugccaggggagcgacgacaucaagcggcuccuggacagccagggccgccgcgacaucaagcucaucgacaucgcgcuguccaaggccgacagccggcgcuucgagaacgccgucugggaccagugcaaggaccugugccacaugcacaccggggugguggucgagaagaagaagcggggcgggaaggaggagaucacgccccacugcgcccucauggacugcaucauguacgacgccgcgguguccggcggccugaacaucccggugcugcgcgccguccucccccgggacaugguguuccgcaccagcucccccaaggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5696 - RNA, 2092 nt, Artificial Sequence
  mRNA product Design2 comprising derived and/or modified sequence from Lassa virus__AIT17705__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaaccgcagccuccaguccgccggcuuccccacggggcugaccuacagccagcugaugacccugaaggacuccaugaugcagcucgaccccagcgccaagaccuggaucgacaucgagggccggccggaggaccccgucgagaucgcgcuguaccagcccauguccgggugcuacauccacuucuuccgcgagcccacggaccugaagcaguucaagcaggacgccaaguacagccacggcaucgacguggccgaccucuucccggcccagcccggccugaccuccgccgucaucgaggcgcugccccggaacauggugcugaccugccaggggagcgacgacaucaagcgccuccuggacagccagggccgccgggacaucaagcucaucgacaucgcccuguccaaggccgacagccgccgguucgagaacgccgugugggaccagugcaaggaccugugccacaugcacaccggggucgugguggagaagaagaagcgcggcgggaaggaggagaucacgccccacugcgcccucauggacugcaucauguacgacgcggccgucuccggcggccugaacaucccggugcugcgggccgugcucccccgcgacauggucuuccggaccagcucccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5697 - RNA, 2092 nt, Artificial Sequence
  mRNA product Design2 comprising derived and/or modified sequence from Lassa virus__AIT17711__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccagcaagucccuccagagcgccggcuuccccacggggcugaccuacucccagcugaugacccugaaggacagcaugaugcagcucgaccccuccgccaagaccuggaucgacaucgagggccgcccggaggaccccgucgagaucgcgcuguaccagcccaugagcgggugcuacauccacuucuuccgggagcccacggaccugaagcaguucaagcaggacgccaaguacucccacggcaucgacguggccgaccucuucccggcccagcccggccugaccagcgccgucaucgaggcgcugccccgcaacauggugcugaccugccaggggagcgacgacaucaagcggcuccuggacucccagggccgccgcgacaucaagcucaucgacaucgcccugagcaaggccgacucccggcgcuucgagaacgccgugugggaccagugcaaggaccugugccacaugcacaccggggucgugguggagaagaagaagcggggcgggaaggaggagaucacgccccacugcgcccucauggacugcaucauguacgacgcggccgucagcggcggccugaacaucccggugcugcgcgccgugcucccccgggacauggucuuccgcaccuccagccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5698 - RNA, 2092 nt, Artificial Sequence
  mRNA product Design2 comprising derived and/or modified sequence from Lassa virus__AIT17713__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaucaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacguccgccgucaucgaggcgcugccccgcaacauggugcugaccugccaggggagcgacgacaucaagcggcuccuggacagccagggccgccgcgacaucaagcugaucgacaucgcccucaacaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5699 - RNA, 2092 nt, Artificial Sequence
  mRNA product Design2 comprising derived and/or modified sequence from Lassa virus__AIT17719__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucuccggcgcgcagggcacccagccggggcgcgacggcguggugcgggucugggacgugaagaaccccgagcuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaacaugguggacaccaagaaguccagccugaacaucagcggcuacaacuucucccugggcgccgccgugaaggccggggccugcaugcucgacggcgggaacaugcuggagacgaucaaggucacgccccagaccauggacggcauccucaagagcauccugaaggugaagaagucccugggcauguucgugagcgacacccccggggagcggaaccccuacgagaacauccuguacaagaucugccucuccggcgacggguggccguacaucgcgagccgcaccuccaucgucggccgggccugggagaacaccaccguggaccuggagagcgacgggaagccccagaaggugggcaccgccggcuccaacaagagccugcaguccgccggguuccccacgggccucaccuacagccagcugaugacccugaaggacuccaugaugcagcuggaccccagcgccaagaccuggaucgacaucgaggggcgcccggaggaccccgucgagaucgcgcucuaccagcccauguccggcugcuacauccacuucuuccgggagcccacggaccugaagcaguucaagcaggacgccaaguacagccacgggaucgacguggccgaccuguucccggcccagcccggccucaccagcgccgucaucgaggcgcugccccgcaacauggugcugaccugccagggcuccgacgacaucaagcggcuccuggacagccaggggcgccgcgacaucaagcugaucgacaucucccucagcaaggccgacucccggcgcuucgagaacgccgugugggaccagugcaaggaccugugccacaugcacaccggcgucgugguggagaagaagaagcgcgggggcaaggaggagaucacgccccacugcgcccugauggacugcaucauguacgacgccgcggucagcgggggccucaacaucccggugcugcgggccgugcugccccgggacauggucuuccgcaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5700 - RNA, 2092 nt, Artificial Sequence
  mRNA product Design2 comprising derived and/or modified sequence from Lassa virus__AIT17725__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagcucggccgcgacgggguggugcgggucugggacgugaagaacccggaccugcugaacaaccaguucggcaccaugcccagccucacccuggccugccugaccaagcagggccagguggaccucaacgacgccguccuggcgcugacggaccucgggcugaucuacaccgccaaguaccccaacuccagcgaccuggaccgccucucccagagccaccccauccugaacaugguggacaccaagaaguccagccugaacaucagcggcuacaacuucucccucggggccgccgugaaggccggcgcgugcaugcuggacgggggcaacaugcuggagaccaucaaggucacgccgcagaccauggacggcauccucaagagcauccugaaggugaagaagucccuggggauguucgugagcgacacccccggcgagcggaaccccuacgagaacauccucuacaagaucugccuguccggggacggcuggcccuacaucgccagccgcaccuccaucgucgggcgggccugggagaacacgaccguggaccuggagagcgacggcaagccgcagaaggugggcaccgccggguccaacaagagccuccaguccgccggcuuccccaccgggcugacguacagccagcugaugacccugaaggacuccaugaugcagcucgaccccagcgcgaagaccuggaucgacaucgagggccgccccgaggacccggucgagaucgcccuguaccagcccauguccgggugcuacauccacuucuuccgggagcccaccgaccugaagcaguucaagcaggacgccaaguacagccacggcaucgacguggccgaccucuuccccgcccagccgggccugacguccgcggucaucgaggcccugccccgcaacauggugcugaccugccaggggagcgaggacaucaagcggcuccuggacagccagggccgccgcgacaucaagcucaucgacaucgcccuguccaaggccgacagccggcgcuucgagaacgccgugugggaccagugcaaggaccugugccacaugcacaccggggucgugguggagaagaagaagcggggcgggaaggaggagaucacgccccacugcgcgcucauggacugcaucauguacgacgccgccgucuccggcggccugaacauccccgugcugcgcgccgugcucccgcgggacauggucuuccgcaccagcucccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5701 - RNA, 2092 nt, Artificial Sequence
  mRNA product Design2 comprising derived and/or modified sequence from Lassa virus__AIT17729__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacccugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcacccaggggacccagccgggccgggacgggguggugcgcgucugggacgugaagaaccccgaccuccugaacaaccaguucggcaccaugcccucccugacgcucgcgugccugaccaagcagggccagguggaccugaacgacgccguccucgcccugaccgaccuggggcucaucuacaccgccaaguaccccaacagcuccgaccuggaccggcugagccagagccacccgauccucaacaugguggacacgaagaaguccagccugaacaucuccggcuacaacuucagccugggggcggccgugaaggccggcgccugcaugcucgacgggggcaacaugcuggagaccaucaaggucacgccccagaccauggacggcauccugaaguccauccucaaggugaagcgcagccuggggauguucguguccgacacccccggcgagcggaaccccuacgagaacauccuguacaagaucugccucagcggggacggcuggccguacaucgccucccgcaccagcaucgucgggcgggcgugggagaacaccaccguggaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacguggccgaccuguucccggcccagcccggccucaccagcgccgucaucgaggcccugccccgcaacauggugcugaccugccaggggagcgacgacaucaagcgccuccuggacucccagggccggcgcgacaucaagcugaucgacaucgcgcucagcaaggccgacucccggaaguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucagcggcggccucaacaucccggugcugcgggccgugcugccccgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5702 - RNA, 2092 nt, Artificial Sequence
  mRNA product Design2 comprising derived and/or modified sequence from Lassa virus__AIT17733__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucauccuggccgccgaccuggagaagcucaagagcaaggugauccgcaccgagcggccccuguccagcgggguguacaugggcaaccuguccacccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacguccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5703 - RNA, 2092 nt, Artificial Sequence
  mRNA product Design2 comprising derived and/or modified sequence from Lassa virus__AIT17745__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaagguggacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5704 - RNA, 2092 nt, Artificial Sequence
  mRNA product Design2 comprising derived and/or modified sequence from Lassa virus__AIT17753__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcaccacggggagcaacaagucccugcagagcgccggcuuccccaccgggcucaccuacucccagcugaugacccugaaggacagcaugaugcagcuggaccccuccgccaagacguggaucgacaucgagggccggccggaggaccccgucgagaucgcccucuaccagcccaugagcgggugcuacauccacuucuuccgcgagcccaccgaccugaagcaguucaagcaggacgcgaaguacucccacggcaucgacguggccgaccuguucccggcccagcccggccucaccagcgccgucaucgaggcccugccccggaacauggugcugaccugccaggggagcgacgacaucaagcgccuccuggacucccagggccgccgggacaucaagcugaucgacaucgcgcucagcaaggccgacucccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucagcggcggccucaacaucccggugcugcgggccgugcugccccgcgacauggucuuccggaccuccagccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5705 - RNA, 2092 nt, Artificial Sequence
  mRNA product Design2 comprising derived and/or modified sequence from Lassa virus__AIT17763__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcggagccuggggauguucgucuccgacacccccggcgagcgcaaccccuacgagaacauccuguacaagaucugccucagcggggacggcuggccguacaucgcgucccggaccagcaucguggggcgcgccugggagaacaccaccguggaccuggaguccgacgagaagccccagaaggucggcgccgccggcagcaacaagucccugcagagcgccggguuccccaccggccucacguacucccagcugaugacccugaaggacagcaugaugcagcuggaccccuccgcgaagaccuggaucgacaucgaggggcggccggaggaccccguggagaucgcccucuaccagcccaugagcggcugcuacauccacuucuuccgcgagcccaccgaccugaagcaguucaagcaggacgccaaguacucccacgggaucgacgucacggaccuguucccggcccagcccggccucaccagcgccgugaucgaggcgcugccccggaacauggugcugaccugccagggcagcgacgacaucaagcgccuccuggacucccaggggcgccgggacaucaagcugaucgacaucgcccucagcaaggccgacucccgccgguucgagaacgccgucugggaccagugcaaggaccugugccacaugcacaccggcgugguggucgagaagaagaagcgcgggggcaaggaggagaucacgccccacugcgcccugauggacugcaucauguacgacgcggccgugagcgggggccucaacaucccggugcugcgggccguccugccccgcgacaugguguuccggaccuccagccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5706 - RNA, 2092 nt, Artificial Sequence
  mRNA product Design2 comprising derived and/or modified sequence from Lassa virus__AIT17771__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagacccagaaggugagcacggccggcuccaacaagagccugcaguccgccggguuccccaccggccucaccuacagccagcugaugacccugaaggacuccaugaugcagcuggaccccagcgccaagacguggaucgacaucgaggggcggcccgaggacccggucgagaucgcgcucuaccagcccauguccggcugcuacauccacuucuuccgcgagcccaccgaccugaagcaguucaagcaggacgccaaguacagccacgggaucgacgugaccgaccuguuccccgcccagccgggccucaccagcgccgucaucgaggcccugccccggaacauggugcugacgugccagggcuccgacgacaucaagcgccuccuggacagccaggggcgccgggacaucaagcugaucgacaucgcgcucuccaaggccgacagccgccgguucgagaacgccgugugggaccagugcaaggaccugugccacaugcacaccggcgucgugguggagaagaagaagcgcgggggcaaggaggagaucacgccccacugcgcccugauggacugcaucauguacgacgccgcggucuccgggggccucaacauccccgugcugcgggccgugcugccgcgcgacauggucuuccggaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5707 - RNA, 2092 nt, Artificial Sequence
  mRNA product Design2 comprising derived and/or modified sequence from Lassa virus__AIT17779__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaagacggacagccggcgcuucgagaacgccgugugggaccagugcaaggaccugugccacaugcacaccggcgucgugguggagaagaagaagcgcgggggcaaggaggagaucacgccccacugcgcccugauggacugcaucauguacgacgccgccgucuccggcgggcucaacauccccgugcugcgggcggugcugccgcgggacauggucuuccgcaccagcucccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5708 - RNA, 2092 nt, Artificial Sequence
  mRNA product Design2 comprising derived and/or modified sequence from Lassa virus__AIT17783__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgucgugcucgcccugaccgaccuggggcucaucuacaccgccaaguaccccaacuccagcgaccuggaccgccugucccagagccacccgauccucaacaugguggacaccaagaaguccagccugaacaucagcggcuacaacuucucccugggggcggccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgccagccgcaccuccaucguggggcgggcgugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccguggagaucgcccucuaccagcccgucuccgggugcuacauccacuucuuccgggagcccacggaccugaagcaguucaagcaggacgcgaaguacagccacggcaucgacguggccgaccuguucccggcccagcccggccucaccuccgccgugaucgaggcccugccccgcaacaugguccugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgccgcgguguccggcggccucaacaucccgguccugcgcgccgugcugccccgggacaugguguuccgcaccagcucccccaaggucgugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5709 - RNA, 2092 nt, Artificial Sequence
  mRNA product Design2 comprising derived and/or modified sequence from Lassa virus__AIT17787__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaagguggacagccggcgcuucgagaacgccgucugggaccagugcaaggaccugugccacaugcacacgggcgugguggucgagaagaagaagcgcgggggcaaggaggagaucacgccccacugcgcccugauggacugcaucauguacgacgccgccguguccggcgggcucaacauccccgugcugcgggcgguccugccgcgggacaugguguuccgcaccagcucccccaaggugguccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5710 - RNA, 2092 nt, Artificial Sequence
  mRNA product Design2 comprising derived and/or modified sequence from Lassa virus__AIT17803__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcucccaggaggcccgggccgggcgcgacggcgugguccgggugugggacgugaagaacgccgagcuccugaacaaccaguucgggaccaugccgagccugacgcucgcgugccugaccaagcagggccaggucgaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggcgccgcggugaaggccggggccugcaugcuggacggcgggaacaugcucgagaccaucaaggucagcccccagacgguggacggcauccugaaguccauccugaaggugaagaaggcccucggcauguucaucagcgacaccccgggggagcggaaccccuacgagaacauccuguacaagaucugccuguccggcgacggguggcccuacaucgccagccgcaccuccaucaccggccgggcgugggagaacacggucguggaccucgagagcgacgggaagccccagaaggccggcuccaacaacagcaacaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgucaccgaccuguucgccgcccagcccgggcucaccuccgcggugaucgacgcccugccccgcaacauggugaucacgugccagggcagcgacgacauccgcaagcugcucgagagccagggccggaaggacaucaagcugaucgacaucgcccuguccaagaccgacagccgcaaguacgagaacgccgucugggaccaguacaaggaccucugccacaugcacaccgggguggucguggagaagaagaagaagggcgggaaggaggagaucacgccccacugcgcgcugauggacugcaucauguucgacgccgccguguccggcgggcugaacaccagcguccuccgggccgugcugccgcgcgacaugguguuccggaccuccacgccccgcgucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5711 - RNA, 2092 nt, Artificial Sequence
  mRNA product Design2 comprising derived and/or modified sequence from Lassa virus__AIT17811__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgccuucuaccagcccuccagcggcugcuacauccacuucuuccgggagccgaccgaccucaagcaguucaagcaggacgccaaguacucccacgggaucgacgugaccgaccuguucgccgcccagcccggccugacgagcgcggucaucgacgcccucccccgcaaccuggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacgccuccgugcugcgggccgugcucccccgggacauggucuuccgcaccagcacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5712 - RNA, 2092 nt, Artificial Sequence
  mRNA product Design2 comprising derived and/or modified sequence from Lassa virus__AIT17815__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuggacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgggacauggucuuccgcaccagcacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5713 - RNA, 2092 nt, Artificial Sequence
  mRNA product Design2 comprising derived and/or modified sequence from Lassa virus__AIT17821__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgguggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacggucguggaccucgaguccgacggcaagccccagaagaccggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccguggaggucgcgcucuaccagcccuccagcggcugcuacauccacuucuuccgggagccgaccgaccugaagcaguucaagcaggacgccaaguacucccacgggaucgacgugaccgaccuguucgccgcccagcccggccucacgagcgccgugaucgacgcgcugccccgcaacauggucaucacgugccagggcuccgacgacauccgcaagcugcucgagagccaggggcggaaggacaucaagcugaucgacaucgcccugagcaagaccgacucccgcaaguacgagaacgccgugugggaccaguacaaggaccucugccacaugcacaccggcgucgugguggagaagaagaagcgcgggggcaaggaggagaucaccccgcacugcgcccugauggacugcaucauguucgacgcggccgucagcgggggccugaacaccuccgugcuccgggccgugcugccccgggacauggucuuccgcaccagcacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5714 - RNA, 2092 nt, Artificial Sequence
  mRNA product Design2 comprising derived and/or modified sequence from Lassa virus__AIT17837__NP (opt1)
ggggcgcugccuacggagguggcagccaucuccuucucggcaucaagcuuaccaugagcaacuccaaggagaucaagagcuuccuguggacccagucccuccgccgggagcugagcggcuacugcuccaacaucaagcuccagguggucaaggacgcccaggcccugcugcacgggcuggacuucagcgagguguccaacgugcagcgccucaugcggaagcagaagcgcgacgacgcggaccugaagcggcugcgcgaccucaaccaggccgucaacaaccugguggagcucaagagcacccagcagaagaacgugcugcgggucggcacgcuguccagcgacgaccugaucacccucgccgccgaccuggagaagcugaaguccaaggugauccgcaccgagcggccccucagcuccgggguguacaugggcaaccugagcucccagcagcuggaccagcgccgggcccuccugagcaugaucgggauguccggcggcccgcaggggaaccgcaccggcggggacggcgucgugcgggugugggacgucaagaacgcggagcugcucaacaaccaguucgggacgaugcccagccugacccuggccugccucaccaagcagggccagguggaccugaacgacgccgugcaggcccugaccgaccucggccugaucuacacggcgaaguaccccaacuccagcgaccuggacaugcucacccagagccaccccauccuggggauggucgacaccaagaaguccagccugaacaucuccggcuacaacuucagccucggggccgccgugaaggccggcgccugcaugcuggacggcgggaacaugcuggagaccaucaagguguccccgcagacgauggacggcauccucaagagcauccugaaggucaagcgcucccuggggauguucaucagcgacacccccggcgagcggaaccccuacgagaacauccucuacaagaucugccuguccggggagggcuggcccuacaucgcgagccgcaccuccaucaccggccgggccugggagaacacgcugguggaccucgagagcgacaacaagccgcccaagcugaacuccgccgggagcaacaagucccugcaggccgccggccucaacgcggggcugaccuacagccagcugaugacccugaaggacugcaugcuccagcuggaccccuccagcaagaccuggaucgacaucgagggccgccccgaggacccgguggagaucgcccuguuccagcccuccagcgggugcuacauccacuucuuccgggagcccacggaccucaagcaguucaagcaggacgccaaguacagccacggcaucgacgucaccgaccuguucuccacccagcccggccugaccagcgccgugaucgaggcccucccgcgcaacauggugcugacgugccagggguccgacgacaucaagaagcugcucgagagccagggccggcgcgacaucaagcugaucgacaucucccugagcaaggcggacucccgcaaguucgagaacgccgucugggaccaguacaaggaccucugccacaugcacaccgggguggucguggagaagaagaagcggggcgggaaggaggagaucacgccccacugcgcccugcuggacugcaucauguucgacgccgccaccaccggcagccucaacaucaccacccugcgcgcggugcugccccgggacauggucuuccgcaccuccacgcccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5715 - RNA, 2092 nt, Artificial Sequence
  mRNA product Design2 comprising derived and/or modified sequence from Lassa virus__AIT17841__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggacggggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcccagcccggccucacgagcgcggucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacaccuccgugcugcgggccgugcucccccgggacauggucuuccgcaccagcacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5716 - RNA, 2092 nt, Artificial Sequence
  mRNA product Design2 comprising derived and/or modified sequence from Lassa virus__AIT17845__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccagacggggcgggacggcgugguccgcgugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccggcugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgccucccggaccagcaucacgggccgcgcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugaccgaccuguucgccgcccagcccggccucacgagcgcggucaucgacgcccugccccggaacauggugaucacgugccagggcuccgacgacauccgcaagcuguucgagagccaggggcgcaaggacaucaagcucaucgacaucgcccugagcaagaccgacucccggaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacaccuccgugcugcgggccgugcucccccgcgacauggucuuccggaccagcacgccccgcguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5717 - RNA, 2092 nt, Artificial Sequence
  mRNA product Design2 comprising derived and/or modified sequence from Lassa virus__ANH09723__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucacccuggccgccgaccuggagaagcucaaguccaaggugacccggacggagcgcccccugaccgccgggguguacaugggcaaccugagcucccagcagcucgaccagcggcgcgcgcugcugaacaugaucgggaugagcggcggcaaccagggggcccggaccggccgcgacggggucgugcgggugugggacgucaagaacgccgagcuccugaacaaccaguucggcaccaugccgucccugacgcucgccugccugaccaagcagggccagguggaccugaacgacgugguccaggcgcucaccgaccuggggcugaucuacaccgccaaguaccccaacacgagcgaccucgaccgccugacccagucccaccccauccugaacaugaucgacaccaacaagagcucccucaacaucagcggcuacaacuucagccugggggccgccgugaaggccggcgcgugcaugcuggacgggggcaacaugcucgagaccaucaaggugagcccccagacgauggacggcauccucaagagcauccugaaggucaagaagucccuggggauguucaucagcgacaccccgggcgagcggaaccccuacgagaacauccuguacaagaucugccuguccggggacggcuggcccuacaucgccagccgcaccuccaucaccgggcgggccugggagaacacggugguggaccucgagagcggcggcaagccccagaaggccggguccaacaacagcaacaagucccugcagagcgccggcuucgcggccgggcugaccuacucccagcucaugacccugaaggacgccaugcugcagcuggacccgaacgccaagaccuggauggacaucgagggccgccccgaggaccccgucgagaucgcccucuaccagcccaucagcgggugcuacauccacuucuuccgggagccgacggaccugaagcaguucaagcaggacgcgaaguacucccacggcaucgacgugaccgaccuguucgccgcccagcccggccucaccagcgccgugaucgaggcccugccccgcaacauggucaucacgugccagggguccgacgacauccgcaagcuguucgagagccagggccggaaggacaucaagcucaucgacaucgcgcuguccaagaccgacagccgcaaguacgagaacgccgugugggaccaguacaaggaccugugccacaugcacaccggggucgugguggagaagaagaagaagggcgggaaggaggagaucacgccccacugcgcccucauggacugcaucauguucgacgccgcggucagcggcggccugaacacccuggugcuccgggccgugcugccgcgcgacauggucuuccggaccuccacccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5718 - RNA, 2092 nt, Artificial Sequence
  mRNA product Design2 comprising derived and/or modified sequence from Lassa virus__ANH09725__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgaccuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaacaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaagucccucgggauguucaucagcgacaccccgggcgagcggaaccccuacgagaacauccuguacaagaucugccugagcggggacggcuggcccuacaucgccucccgcaccagcaucacggggcgggccugggagaacaccgugguggaccucgaguccggcggcaagccccagaaggccgggagcaacaacuccaacaagagccugcaguccgcgggcuucgccgccgggcugaccuacagccagcucaugacccugaaggacgccaugcugcagcuggacccgaacgccaagacguggauggacaucgagggccgccccgaggaccccgucgagaucgcgcucuaccagcccaucuccgggugcuacauccacuucuuccgggagccgaccgaccugaagcaguucaagcaggacgccaaguacagccacggcaucgacgugaccgaccuguucgccgcccagcccggccucaccuccgccgugaucgaggcgcugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccggggucgugguggagaagaagaagcggggcgggaaggaggagaucacgccccacugcgcccugauggacugcaucauguucgacgcggccgucuccggcggccugaacacccucgugcugcgcgccgugcugccgcgggacauggucuuccgcaccagcacccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5719 - RNA, 2092 nt, Artificial Sequence
  mRNA product Design2 comprising derived and/or modified sequence from Lassa virus__ANH09729__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccuccgacgaccugcucacccuggccgccgaccuggagaagcucaagagcaaggugacccggacggagcgcccccuguccgccgggguguacaugggcaaccugagcucccagcagcucgaccagcggcgcgcgcugcugaacaugaucgggaugagcggcggcaaccagggggcccggaccggccgcgacggggucgugcgggugugggacgucaagaacgccgaccuccugaacaaccaguucggcaccaugccgucccugacccucgccugccugacgaagcagggccagguggaccugaacgacgugguccaggcgcucaccgaccuggggcugaucuacaccgccaaguaccccaacaccagcgaccucgaccgccugacgcagucccaccccauccugaacaugaucgacaccaacaagagcagccucaacaucuccggcuacaacuucagccugggggccgccgugaaggccggcgcgugcaugcuggacgggggcaacaugcucgagaccaucaaggugagcccccagaccauggacggcauccucaagagcauccugaaggucaagaagucccuggggauguucaucagcgacacgccgggcgagcggaaccccuacgagaacauccuguacaagaucugccuguccggggacggcuggcccuacaucgccagccgcaccuccaucaccgggcgggccugggagaacaccgugguggaccucgagagcggcggcaagccccagcgcgccggguccaacaacagcaacaagucccugcagagcgccggcuucgcggccgggcugacguacucccagcucaugacccugaaggacgccaugcugcagcuggacccgaacgccaagaccuggauggacaucgagggccggcccgaggaccccgucgagaucgcccucuaccagcccaccagcgggugcuacauccacuucuuccgcgagccgacggaccugaagcaguucaagcaggacgcgaaguacucccacggcaucgacgugaccgaccuguucgccgcccagcccggccucaccagcgccgugaucgaggcccugccccgcaacauggucaucacgugccagggguccgacgacauccggaagcugcucgagagccagggccgcaaggacaucaagcugaucgacaucgcgcugagcaagaccgacucccggaaguacgagaacgccgugugggaccaguacaaggaccucugccacaugcacaccggggucgugguggagaagaagaagaagggcgggaaggaggagaucacgccccacugcgcccugauggacugcaucauguucgacgccgcggucagcggcggccugaacacccucgugcugcgcgccgugcugccgcgggacauggucuuccgcaccuccacccccaagguggugcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5720 - RNA, 2092 nt, Artificial Sequence
  mRNA product Design2 comprising derived and/or modified sequence from Lassa virus__ANH09731__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucacccuggccgccgaccuggagaagcucaaguccaaggugacccggacggagcgcccccugagcgccgggguguacaugggcaaccuguccagccagcagcucgaccagcggcgcgcgcugcugaacaugaucgggaugaccggcggcaaccagggggcccggaccggccgcgacggggucgugcgggugugggacgucaagaacgccgaccuccugaacaaccaguucggcaccaugccgucccugacgcucgccugccugaccaagcagggccagguggaccugaacgacgugguccaggcgcucaccgaccuggggcugaucuacaccgccaaguaccccaacacgagcgaccucgaccgccugacccagucccaccccauccugaacaugaucgacaccaacaagagcucccucaacaucagcggcuacaacuucagccugggggccgccgugaaggccggcgcgugcaugcuggacgggggcaacaugcucgagaccaucaaggugagcccccagacgauggacggcauccucaagagcauccugaaggucaagaagucccuggggauguucaucagcgacaccccgggcgagcggaaccccuacgagaacauccuguacaagaucugccuguccggggacggcuggcccuacaucgccagccgcaccuccaucaccgggcgggccugggagaacacggugguggaccucgagagcggcggcaagccccagcgcgccggguccaacaacagcaacaagucccugcagagcgccggccuggcggccgggcucaccuacucccagcugaugacccugaaggacgccaugcugcagcucgacccgaacgccaagaccuggauggacaucgagggccggcccgaggaccccgucgagaucgcccuguaccagcccacgagcgggugcuacauccacuucuuccgcgagccgaccgaccugaagcaguucaagcaggacgcgaaguacucccacggcaucgacgugaccgaccucuucgccgcccagcccggccugaccagcgccgugaucgaggcccugccccgcaacauggucaucacgugccagggguccgacgacauccggaagcuccuggagagccagggccgcaaggacaucaagcugaucgacaucgcgcucuccaagaccgacagccggaaguacgagaacgccgugugggaccaguacaaggaccugugccacaugcacaccggggucgugguggagaagaagaagaagggcgggaaggaggagaucacgccccacugcgcccugauggacugcaucauguucgacgccgcggucagcggcggccucaacacccuggugcugcgcgccgugcucccgcgggacauggucuuccgcaccuccacccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5721 - RNA, 2092 nt, Artificial Sequence
  mRNA product Design2 comprising derived and/or modified sequence from Lassa virus__ANH09733__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucacccuggccgccgaccuggagaagcucaaguccaaggugacccggacggagcgcccccugagcgccgggguguacaugggcaaccuguccagccagcagcucgaccagcggcgcgcgcugcugaacaugaucgggauguccggcggcaaccagggggcccggaccggccgcgacggggucgugcgggugugggacgucaagaacgccgaccuccugaacaaccaguucggcaccaugccgagccugacccucgccugccugacgaagcagggccagguggaccugaacgacgugguccaggcgcucaccgaccuggggcugaucuacaccgccaaguaccccaacaccuccgaccucgaccgccugacgcagagccaccccauccugaacaugaucgacaccaacaaguccagccucaacaucagcggcuacaacuucucccugggggccgccgugaaggccggcgcgugcaugcuggacgggggcaacaugcucgagaccaucaaggugagcccccagaccauggacggcauccugaaguccauccugaaggucaagaagucccucgggauguucaucagcgacacgccgggcgagcggaaccccuacgagaacauccuguacaagaucugccugagcggggacggcuggcccuacaucgccucccgcaccagcaucaccgggcgggccugggagaacaccgugguggaccucgaguccggcggcaagccccagcgcgccgggagcaacaacuccaacaagagccugcaguccgccggcuucgcggccgggcugacguacagccagcucaugacccugaaggacgccaugcugcagcuggacccgaacgccaagaccuggauggacaucgagggccggcccgaggaccccgucgagaucgccuucuaccagcccaucuccgggugcuacauccacuucuuccgcgagccgaccgaccucaagcaguucaagcaggacgcgaaguacagccacggcaucgacgugacggaccuguucgccgcccagcccggccugaccuccgccgugaucgaggcccucccccgcaacauggucaucacgugccaggggagcgacgacauccggaagcugcuggagucccagggccgcaaggacaucaagcucaucgacaucgcgcugagcaagaccgacagccggaaguacgagaacgccgugugggaccaguacaaggaccugugccacaugcacaccggggucgugguggagaagaagaagaagggcgggaaggaggagaucacgccccacugcgcccucauggacugcaucauguucgacgccgcggucuccggcggccugaacacccuggugcuccgcgccgugcugccgcgggacauggucuuccgcaccagcacccccaagguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5722 - RNA, 2092 nt, Artificial Sequence
  mRNA product Design2 comprising derived and/or modified sequence from Lassa virus__ANH09735__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacgaacggcggccagggggcgaacgccggccgggacgggaucguccgcgugugggacgugaagaacgccgagcuccugaacaaccaguucggcaccaugcccucccugacccucgccugccugaccaagcaggggcaggucgaccugaacgacgcggugcaggcccucacggaccugggccugaucuacaccgccaaguaccccaacagcuccgaccucgaccggcugagccagaaccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagacgauggacggcauccugaaguccauccugaaggugaagcgcagccucgggauguucguguccgacaccccgggcgagcggaaccccuacgagaacauccuguacaagaucugccugagcggggacggcuggcccuacgucgccucccgcaccagcaucaucgggcgggccugggagaacaccgugguggaccucgaguccgacagcaagccccagcgcccgggcuccaaggagagcaaccggucccugcagacggccggcuuccccgcggggcugaccuacagccagcucaugacccugaaggacuccaugcugcagcuggaccccaacgccaagaccuggauggacaucgagggccgccccgacgacccggucgagaucgcccucuaccagcccagcuccgggugcuacauccacuucuuccgcgagcccacggaccugaagcaguucaagcaggacgccaaguacagccacggcaucgacaucggggaccuguucgccgcgcagcccggccucaccagcgccgugaucgaggcccugccgcggaacauggugaucacgugccagggcuccgaggacaucaagcgccugcucgagagccaggggcggaaggacauccgccuggucgacaucucccugagcaaggccgacucccggaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgcgcggugcugcccaaggacauggucuuccggaccagcacgccccgcguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5723 - RNA, 2092 nt, Artificial Sequence
  mRNA product Design2 comprising derived and/or modified sequence from Lassa virus__ANH09737__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacgaacggcggccagggggcgaacgccggccgggacgggaucguccgcgugugggacgugaagaacgccgagcuccugaacaaccaguucggcaccaugcccucccugacccucgccugccugaccaagcaggggcaggucgaccugaacgacgcggugcaggcccucacggaccugggccugaucuacaccgccaaguaccccaacagcuccgaccucgaccggcugagccagaaccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagacgauggacggcauccugaaguccauccugaaggugaagcgcagccucgggauguucguguccgacaccccgggcgagcggaaccccuacgagaacauccuguacaagaucugccugagcggggacggcuggcccuacgucgccucccgcaccagcaucaucgggcgggccugggagaacaccgugguggaccucgaguccgacagcaagccccagcgcccgggcuccaaggagagcaaccggucccugcagacggccggcuuccccgcggggcugaccuacagccagcucaugacccugaaggacuccaugcugcagcuggaccccaacgccaagaccuggauggacaucgagggccgccccgacgacccggucgagaucgcccucuaccagcccagcuccgggugcuacauccacuucuuccgcgagcccacggaccugaagcaguucaagcaggacgccaaguacagccacggcaucgacaugggggaccuguucgccgcgcagcccggccucaccagcgccgugaucgaggcccugccgcggaacauggugaucacgugccagggcuccgaggacaucaagcgccugcucgagagccaggggcggcgcgacauccggcuggucgacaucucccugagcaaggccgacucccgcaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgggcggugcugcccaaggacauggucuuccgcaccagcacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5724 - RNA, 2092 nt, Artificial Sequence
  mRNA product Design2 comprising derived and/or modified sequence from Lassa virus__ANH09739__NP (opt1)
ggggcgcugccuacggagguggcagccaucuccuucucggcaucaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacguccggcggccagggggcgaacgccggccgggacgggaucguccgcgugugggacgugaagaacgccgagcuccugaacaaccaguucggcaccaugcccagccugacccucgccugccugaccaagcaggggcaggucgaccugaacgacgcggugcaggcccucacggaccugggccugaucuacaccgccaaguaccccaacuccagcgaccucgaccggcugagccagaaccaccccauccugaacaugaucgacaccaagaaguccagccucaacaucuccggcuacaacuucagccugggggccgccgugaaggcgggcgccugcaugcuggacgggggcaacaugcucgagaccaucaaggucagcccccagacgauggacggcauccucaagagcauccugaaggugaagcgcucccuggggauguucgugagcgacaccccgggcgagcggaaccccuacgagaacauccuguacaagaucugccuguccggggacggcuggcccuacgucgccagccgcaccuccaucaucgggcgggccugggagaacaccgugguggaccucgagagcgacuccaagccccagcgcccgggcagcaaggaguccaaccggagccugcagacggccggcuuccccgcggggcugaccuacucccagcucaugacccugaaggacagcaugcugcagcuggaccccaacgccaagaccuggauggacaucgagggccgccccgacgacccggucgagaucgcccucuaccagcccuccagcgggugcuacauccacuucuuccgcgagcccacggaccugaagcaguucaagcaggacgccaaguacagccacggcaucgacaucggggaccuguucgccgcgcagcccggccucaccuccgccgugaucgaggcccugccgcggaacauggugaucacgugccagggcagcgaggacaucaagcgccugcucgagucccaggggcggcgcgacauccggcuggucgacaucagccuguccaaggccgacagccgcaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgggcggugcugcccaaggacauggucuuccgcaccuccacgccccggguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5725 - RNA, 2092 nt, Artificial Sequence
  mRNA product Design2 comprising derived and/or modified sequence from Lassa virus__ANH09741__NP (opt1)
ggggcgcugccuacggagguggcagccaucuccuucucggcaucaagcuuaccaugagcaacuccaaggaggugaaguccuuccuguggacccagagccuccgccgggagcugagcggcuacugcaccaacaucaagcugcaggucgugaaggacgcccaggcccuccugcacgggcuggacuucuccgaggugagcaacguccagcgccucaugcggaagcagaagcgcgacgacaacgaccugaagcggcugcgcgaccucaaccaggcggugaacaaccugguggagcugaaguccguccagcagaaguccgugcucaaggugggcacgcugaacagcgacgaccugcucacccuggccgccgaccuggagaagcucaagagcaaggucgugcggaccgagcgcccccuguccagcgggguguacaugggcaaccuguccagccagcagcucgaccagcggcgcgcccugcugaacaugaucgggauggccggcggcucccaggggaaccagccgagccgggacggcgucgugcgcgugugggacgucaagaacgcggaccuccugaacaaccaguucgggaccaugcccucccugacgcucgccugccugaccaagcagggccagguggaccugaacgacgugguccucgcccugaccgaccuggggcucaucuacaccgccaaguaccccaacagcuccgaccuggaccggcugagccagaaccaccccgugcucaacaugaucgacgugaacaagagcucccugaacaucagcggcuacaacuucucccugggcgcggccgucaaggccggggccugcaugcucgacggcgggaacaugcuggagacgaucaagaucagcccgcagaccguggacggcauccugaaguccauccucaaggugaagcgcgcccugggcauguucgucagcgacacccccggggagcggaaccccuacgagaacauccuguacaaggugugccucuccggcaacggguggcccuacaucgcgagccgcaccuccaucgucggccgggccugggagaacacggugguggaccuggagagcaacaagaaccagccgaaggucgggaacaacggcuccaacaagaugcugcagagcuccggcuucgccaccgggcucaccuacagccagcugaugacccugcgcgacuccaugcugcagcucgaccccacggccaagaccuggaucgacaucgagggccggcccgaggaccccguggagcuggcccuguuccagccgagcuccgggugcuacauccacuucuuccgcgagcccaccgaccucaagcaguucaagcaggacgcgaaguacagccacggcaucgacgugaacgaccuguucuccgcccagcccgggcugaccagcgccguccucgaggcccugccccggaacauggugcugacgugccagggcagcgacgacauccgcaagcuccuggacucccaggaccgcaaggacaucaagcugaucgacaucagccucuccaaggccgacgcgcggaaguucgagaacgacgugugggaccaguucaaggaccugugccacaugcacaccggcaucgucguggagaagaagaagaagggcgggaagcaggagaugaccccgcacugcgcccugcucgacugcaucauguucgacgccgccgugagcgggggccugaacguccccacccugcgcgccgugcuccccacggacaugguguuccggaccaucaccaccaaggucgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5726 - RNA, 2095 nt, Artificial Sequence
  mRNA product Design2 comprising derived and/or modified sequence from Lassa virus__CAA36646__NP (opt1)
ggggcgcugccuacggagguggcagccaucuccuucucggcaucaagcuuaccaugagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagaagcgggacgacggcgaccugaagcgccugcgggaccucaaccaggccgugaacaaccugguggagcucaagagcacccagcagaaguccguccugcgcguggggacccugagcuccgacgaccugcucauccuggccgccgaccuggagaagcucaagagcaaggugacccggaccgagcgcccccuguccagcggcgucuacauggggaaccuguccagccagcagcucgaccagcggcgcgcccugcugaacaugaucggcaugaccggcguguccgggggcgggaagggcgcgagcgacgggaucgugcgggucugggacgugaagaacgccgagcuccugaacaaccaguucggcacgaugccgucccugacccucgccugccugaccaagcagggccagguggaccugaacgacgccguccaggcgcucaccgaccuggggcugaucuacacggccaaguaccccaacagcagcgaccucgaccgccugucccagagccaccccauccugaacaugaucgacaccaagaaguccagccucaacaucuccggcuacaacuucagccugggggccgccgugaaggccggcgcgugcaugcuggacggcgggaacaugcucgagaccaucaaggugagcccccagaccauggacggcauccucaaguccauccugaaggucaagaagucccuggggauguucgugagcgacacgccgggcgagcggaaccccuacgagaacauccuguacaagaucugccuguccggggacggcuggcccuacaucgccagccgcaccuccaucgugggccgggccugggagaacaccgucguggaccucgagcaggacaacaagccccagaagaucgggaacggcgggagcaacaagucccugcagagcgccggcuucgccgcggggcugaccuacucccagcucaugacgcugaaggacuucaagugcuucaaccugaucccgaacgccaagaccuggauggacaucgagggccgccccgaggaccccguggagaucgcccuguaccagcccagcuccggcugcuacguccacuucuuccgggagccgaccgaccucaagcaguucaagcaggacgccaaguacagccacgggaucgacgugaccgaccuguucgccgcgcagcccggccugacgagcgccgucaucgaggcccucccccgcaacauggugaucacgugccagggguccgaggacauccggaagcugcuggagagccagggccgccgcgacaucaagcucaucgacaucacccuguccaaggccgacagccggaaguucgagaacgccgugugggaccaguucaaggaccugugccacaugcacaccggggucgugguggagaagaagaagcgcggcggcaaggaggagaucacgccccacugcgcgcucauggacugcaucauguucgacgccgccgucuccgggggccuggacgccaaggugcugcgggugguccucccgcgcgacaugguguuccggaccagcacccccaaggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5727 - RNA, 2092 nt, Artificial Sequence
  mRNA product Design2 comprising derived and/or modified sequence from Lassa virus__CCA30315__NP (opt1)
ggggcgcugccuacggagguggcagccaucuccuucucggcaucaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacagcgaccugaagcgccugcgggaccucaaccaggccgugaacaaccugguggagcugaaguccacccagcagaaguccguccuccgcgugggcacgcugagcagcgacgaccugcucacccuggccgccgaccuggagaagcucaaguccaaggugacccggaccgagcgcccccugagcuccggggucuacaugggcaaccugagcucccagcagcucgaccagcggcgcgcccugcugaaccucaucgggaugacgaacggcagccagggcucccaggcggggcgggacggcguggugcgcgucugggacgugaagaacgccgagcugcugaacaaccaguucgggaccaugccgagccucacccuggccugccugaccaagcagggccagguggaccucaacgacgucgugcaggcccugacggaccuggggcucaucuacaccgcgaaguaccccaacaccagcgaccuggaccggcugacccagucccaccccauccucaacaugaucgacacgaagaaguccagccugaacaucagcggcuacaacuucucccugggcgccgccgugaaggccggggccugcaugcucgacggcgggaacaugcuggagaccaucaaggucagcccccaguccauggacggcauccucaagagcauccugaaggugaagcgcgcgcugggcauguucguguccgacaccccgggggagcggaaccccuacgagaacauccuguacaagaucugccucagcggcgacggguggcccuacaucgccucccgcaccagcaucgucggccgggccugggagaacacggugguggaccuggagaccgacgggaagccccagaagaucggcuccggcaacagcaacaagucccugcagagcgccggguucuccgccggccucaccuacagccagcugaugacccugaaggacgcgaugcugcagcucgacccgaacgccaagacguggauggacaucgaggggcgccccgaggaccccgucgagguggcccuguaccagcccaucuccggcugcuacauccacuucuuccgggagccgaccgaccugaagcaguucaagcaggacgccaaguacagccacgggaucgacaucgccgaccucuucgcggcccagcccggccugaccagcgccgucaucgaggcccugccccgcaacauggugaucacgugccagggcuccgaggacaucaagaagcuccuggagagccaggggcgcaaggacaucaagcugaucgacaucgcccucuccaagaucgacagccggaaguucgagaacgcggugugggaccaguacaaggaccugugccacaugcacaccggcgucgugguggagaagaagaagcgcgggggcaaggaggagaucaccccgcacugcgcccugauggacugcaucauguucgacgccgccgucuccgggggccucaacacccuggugcugcgggcggugcucccccgcgacauggucuuccggaccagcacgccccgcguggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5728 - RNA, 2092 nt, Artificial Sequence
  mRNA product Design2 comprising derived and/or modified sequence from Lassa virus__JX985061__NP (opt1)
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5729 - RNA, 2092 nt, Artificial Sequence
  mRNA product Design2 comprising derived and/or modified sequence from Lassa virus__NP_694869__NP (opt1) R6024
ggggcgcugccuacggagguggcagccaucuccuucucggcaucaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcaccaugccgagccugacgcucgcgugccugaccaagcaggggcaggucgaccugaacgacgccgugcaggcccucaccgaccugggccugaucuacaccgccaaguaccccaacacguccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagaccaucaaggucagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacgguggucgaccucgagagcgacggcaagccccagaaggccgacuccaacaacagcuccaagagccugcaguccgccggcuucaccgccgggcugaccuacagccagcucaugacccugaaggacgccaugcugcagcuggacccgaacgcgaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgugaccgaccuguucgccacccagcccgggcucacgagcgccgucaucgacgcgcugccccgcaacauggugaucacgugccagggcuccgacgacauccgcaagcugcucgagagccagggccggaaggacaucaagcugaucgacaucgcccugagcaagaccgacucccgcaaguacgagaacgccgugugggaccaguacaaggaccucugccacaugcacaccggggucguggucgagaagaagaagcggggcgggaaggaggagaucaccccgcacugcgcccugauggacugcaucauguucgacgcggccgugagcggcgggcugaacaccuccgugcuccgcgccguccugccccgggacaugguguuccgcaccagcacgccccgggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5730 - RNA, 2092 nt, Artificial Sequence
  mRNA product Design2 comprising derived and/or modified sequence from Lassa virus__SCA79106__NP (opt1)
ggggcgcugccuacggagguggcagccaucuccuucucggcaucaagcuuaccaugagcaacuccaaggaggugaaguccuuccuguggacccagagccuccgccgggagcugagcggcuacugcuccaacaucaagcugcaggucgugaaggacgcccaggcccuccugcacgggcuggacuucagcgagguguccaacguccagcgccucaugcggaagcagaagcgcgacgacggcgaccugaagcggcugcgcgaccucaaccaggcggugaacaaccugguggagcucaagagcguccagcagaaguccauccugcggguggggacccugaccagcgacgaccugcucacccuggccgccgaccuggagaagcucaaguccaaggugacccgcaccgagcggccccugagcuccggcgucuacauggggaaccugagcucccagcagcucgaccagcgccgggcccugcugagcaugaucggcauguccggcgggaaccagaacagccagccgaagggcgacgggguggugcgcgucugggacgugaagaacgccgaccuccugaacaaccaguucggcacgaugcccucccugacccucgcgugccugaccaagcagggccagguggaccugaacgacgccguccaggcccucaccgaccuggggcugaucuacacggccaaguaccccaacagcagcgaccucgaccggcugucccagagccaccccauccugaacaugaucgacaccaagaaguccagccucaacaucuccggcuacaacuucagccugggggcggccaucaagaccggcgccugcaugcuggacgggggcaacaugcucgagaccaucaaggugacgccgcagaccauggacggcauccugaaguccauccugaaggugaagcgcagccucgggauguucaucuccgacacccccggcgagcggaaccccuacgagaacauccuguacaagaucugccugagcggggacggcuggcccuacaucgccucccgcaccgccaucaucgggcgggcgugggagaacacggucguggaccucgagagcgacuccaagccgcagaagaucggcagcaacggcuccaacaagagccugcaguccgccggguucgcccccggccugaccuacagccagcucaugacccugaaggacuccaugcugcagcuggaccccaacgccaagaccuggaucgacaucgaggggcgccccgaggacccgguggaggucgcccucuuccagcccaucagcggcugcuacauccacuucuuccgggagcccacggaccugaagcaguucaagcaggacgcgaaguacagccacgggaucgacgugaccgaccuguucgccgcccagcccggccucaccuccgccgugaucgaggcccugccgcgcaacaugguccugaccugccagggcagcgacgacaucaagaagcuccuggacucccaggggcggcgcgacaucaagcugaucgacgugagccucaacaagaucgacucccgcaaguucgagaacgcggucugggaccaguacaaggaccugugccacaugcacacgggcgugguggucgagaagaagaagaagggcgggaaggaggagaucacgccccacugcgcccugcucgacugcaucauguucgacgccgccgugagcgggggccugaacgccaccgugcugcgggcgguccucccccgcgacaugguguuccggaccuccagccccaaggugguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5731 - RNA, 682 nt, Artificial Sequence
  mRNA product Design2 comprising derived and/or modified sequence from Lassa virus__ADY11072__Z (opt1) R6025
ggggcgcugccuacggagguggcagccaucuccuucucggcaucaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccgcugcccacgaagcuccgccccagcgccgcccccaccgccccgcccaccggggcggccgacuccauccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5732 - RNA, 682 nt, Artificial Sequence
  mRNA product Design2 comprising derived and/or modified sequence from Lassa virus__AAO59514__Z (opt1)
ggggcgcugccuacggagguggcagccaucuccuucucggcaucaagcuuaccaugggcaacaagcagguccgcagcaugaagaagguggacagcccccgggccucccugauccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugccgaccaagcucaagaccuccacgacccccaccgcgcccagcauccgcgaggccaacaccacgagcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5733 - RNA, 682 nt, Artificial Sequence
  mRNA product Design2 comprising derived and/or modified sequence from Lassa virus__AAO59508__Z (opt1)
ggggcgcugccuacggagguggcagccaucuccuucucggcaucaagcuuaccaugggcaaccgccaggccaagaaccccgagguggagaacagcccccgggccucccugauccccgacgcgacccaccucgggccccaguucugcaagagcugcugguucgagaacaagggccuggucgagugcaacaaccacuaccugugccucaacugccugucccugcuccugagcguguccaaccgcugccccaucugcaagaugccgcugcccacccggcuccgccccacgaccacccccaccgccccgcagaucaucaaggagaacacgaccaacccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5734 - RNA, 682 nt, Artificial Sequence
  mRNA product Design2 comprising derived and/or modified sequence from Lassa virus__AAO59510__Z (opt1)
ggggcgcugccuacggagguggcagccaucuccuucucggcaucaagcuuaccaugggcaacaagcagaccaaggcccccgaggccaaggacagcccgcgcgcgucccugauccccgacgccaccuaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgcgggggccgcccacagcgcccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5735 - RNA, 682 nt, Artificial Sequence
  mRNA product Design2 comprising derived and/or modified sequence from Lassa virus__AAT48997__Z (opt1)
ggggcgcugccuacggagguggcagccaucuccuucucggcaucaagcuuaccaugggcaacaagcaggccaaggcccccgagaccaagaacagcccccgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgugcccaccgccccgcccgcccaggugggggaccggacccgcccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5736 - RNA, 682 nt, Artificial Sequence
  mRNA product Design2 comprising derived and/or modified sequence from Lassa virus__AAT49005__Z (opt1)
ggggcgcugccuacggagguggcagccaucuccuucucggcaucaagcuuaccaugggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccacccgccuccggcccuccgccgugcccaccgccccgcccgcccccgcgggggaccgcaccaagcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5737 - RNA, 682 nt, Artificial Sequence
  mRNA product Design2 comprising derived and/or modified sequence from Lassa virus__ADU56612__Z (opt1)
ggggcgcugccuacggagguggcagccaucuccuucucggcaucaagcuuaccaugggcaaccgccagacccggcccaccgaggccacggagcagagccgcgcccaccuggugccggacgccucccaccucgggccccaguucugcaagagcugcugguucgagaaccggggccuggucgagugcaacaaccacuaccugugccucaacugccugucccugcuccugagcguguccagccgcugccccaucugcaagaugccccugccgacccggcucaaggccuccgcccagcccagcgccccgcccaccgaggcgccccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5738 - RNA, 682 nt, Artificial Sequence
  mRNA product Design2 comprising derived and/or modified sequence from Lassa virus__ADU56616__Z (opt1)
ggggcgcugccuacggagguggcagccaucuccuucucggcaucaagcuuaccaugggcgggaagcacaccaagcagccccgcgagagcaacuccccgcgggccagccugauccccgacgccacccaccucggcccccaguucugcaaguccugcugguucgagaacaaggggcugguggagugcaacaaccacuaccugugccucaacugccugagccugcuccuguccgucagcaaccgcugccccaucugcaagaugccccugcccacgcggcuccgcaccuccaccaaccccaccgcgccccagguggagcagacgggcccggccagcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5739 - RNA, 682 nt, Artificial Sequence
  mRNA product Design2 comprising derived and/or modified sequence from Lassa virus__ADU56620__Z (opt1)
ggggcgcugccuacggagguggcagccaucuccuucucggcaucaagcuuaccaugggcgggaagcacaccaagccccagcgcgagagcaacuccccgcgggccagccugauccccgacgccacccaccucggcccccaguucugcaaguccugcugguucgagaacaaggggcugguggagugcaacaaccacuaccugugccucaacugccugacgcugcuccugagcguguccaaccgcugccccaucugcaagaugccccugcccacccggcuccgcgccagcaccaaccccaccgcgccccagguggagcaggucggcccgacgaacccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5740 - RNA, 682 nt, Artificial Sequence
  mRNA product Design2 comprising derived and/or modified sequence from Lassa virus__ADU56624__Z (opt1)
ggggcgcugccuacggagguggcagccaucuccuucucggcaucaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5741 - RNA, 682 nt, Artificial Sequence
  mRNA product Design2 comprising derived and/or modified sequence from Lassa virus__ADU56628__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5742 - RNA, 682 nt, Artificial Sequence
  mRNA product Design2 comprising derived and/or modified sequence from Lassa virus__ADU56632__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgacccaggacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5743 - RNA, 682 nt, Artificial Sequence
  mRNA product Design2 comprising derived and/or modified sequence from Lassa virus__ADU56644__Z (opt1)
ggggcgcugccuacggagguggcagccaucuccuucucggcaucaagcuuaccaugggcaaccgccagaccaaggcccccgaggccaaggggagcccccgggcgucccugauccccgacgccacccaccucggcccccaguucugcaagagcugcugguucgagaacaaggggcugguggagugcaacgaccacuaccugugccucaacugccugacgcugcuccuguccgucagcucccgcugccccaucugcaagaugccgcugcccacccggcuccgccccagcaccaaccccaccgccccgcccgcccgggccgagggcgggaucaacccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5744 - RNA, 682 nt, Artificial Sequence
  mRNA product Design2 comprising derived and/or modified sequence from Lassa virus__AHC95545__Z (opt1)
ggggcgcugccuacggagguggcagccaucuccuucucggcaucaagcuuaccaugggcaacaagcaggccaaggaccccaagaccgagagcuccccgcgcgccagccugauccccgacgcgacccaccucgggccccaguucugcaaguccugcugguucgagaacaagggccugguggagugcaacaaccacuaccugugccucaacugccugagccugcuccuguccgucagcaaccggugccccaucugcaagaugccccugcccacgaagcucaagcccaucaccacccccaccgccccgcagaucacgcgcgaguccaucaccaacccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5745 - RNA, 682 nt, Artificial Sequence
  mRNA product Design2 comprising derived and/or modified sequence from Lassa virus__AHC95547__Z (opt1)
ggggcgcugccuacggagguggcagccaucuccuucucggcaucaagcuuaccaugggcaaccgccaggccaaggaccccaagguggagagcuccccgcgggccagccugauccccgacgcgacccaccucgggccccaguucugcaaguccugcugguucgagaacaagggccuggucgagugcaacaaccacuaccugugccucaacugccugagccugcuccuguccgugagcaaccgcugccccaucugcaagaugccccugcccacccggcuccgccccacgaccaugcccaccgccccgcagaucaucaaggaggggaccacgaacccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5746 - RNA, 682 nt, Artificial Sequence
  mRNA product Design2 comprising derived and/or modified sequence from Lassa virus__AIT17124__Z (opt1)
ggggcgcugccuacggagguggcagccaucuccuucucggcaucaagcuuaccaugggcaacaagcaggucaagacccccgaggccaaggacagcccccgcgccucccugauccccgacgcgacccaccucgggccccaguucugcaagagcugcugguucgagaacaagggccugguggagugcaacaaccacuaccugugccucaacugccugacgcugcuccuguccguggggaaccggugccccaucugcaagaugccgcugcccaccaagcuccgccccagcgugacccccaccgccccgcccacgcgggccgccgacuccaucggcccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5747 - RNA, 682 nt, Artificial Sequence
  mRNA product Design2 comprising derived and/or modified sequence from Lassa virus__AIT17128__Z (opt1)
ggggcgcugccuacggagguggcagccaucuccuucucggcaucaagcuuaccaugggcaacaagcaggccaagacccccgaggccaaggacagcccgcgcgcgaaccugauccccgacgccacccaccucgggccccaguucugcaaguccugcugguucgagaacaagggccugguggagugcaacaaccacuaccugugccucaacugccugacgcugcuccugagcgucuccaaccggugccccaucugcaagaugccgcugcccaccaagcuccgccccagcgccgcccccaccgccccgcccaccggggcggccgacuccauccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5748 - RNA, 682 nt, Artificial Sequence
  mRNA product Design2 comprising derived and/or modified sequence from Lassa virus__AIT17132__Z (opt1)
ggggcgcugccuacggagguggcagccaucuccuucucggcaucaagcuuaccaugggcaacaagcaggccaaggcccccgaggcgcgcgacagcccccgggccucccugauccccgacgccacccaccucgggccccaguucugcaagagcugcugguucgagaacaagggccugguggagugcaacaaccacuaccugugccucaacugccugacccugcuccuguccgucagcaaccgcugccccaucugcaagaugccgcugcccacgaagcuccggcccuccgccacccccaccgccccgcccaccgaggcggccgacagcauccgcccgccgcccuaccggcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5749 - RNA, 682 nt, Artificial Sequence
  mRNA product Design2 comprising derived and/or modified sequence from Lassa virus__AIT17136__Z (opt1)
ggggcgcugccuacggagguggcagccaucuccuucucggcaucaagcuuaccaugggcaacaagcagaccaaggcccccgagagcaagaacuccccgcgcgccagccugauccccgacgcgaccuaccucgggccccaguucugcaaguccugcugguucgagaacaagggccugguggagugcaacaaccacuaccugugccucaacugccugacgcugcuccugagcgucuccaaccggugccccaucugcaagaugccgcugcccaccaagcuccgcagcuccgccgcccccaccgcgcccccgaccggggccgccgacagcacgaagcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5750 - RNA, 682 nt, Artificial Sequence
  mRNA product Design2 comprising derived and/or modified sequence from Lassa virus__AIT17140__Z (opt1)
ggggcgcugccuacggagguggcagccaucuccuucucggcaucaagcuuaccaugggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccgccgccccgaccgccccgcccgcgggggccguggacagcacccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5751 - RNA, 682 nt, Artificial Sequence
  mRNA product Design2 comprising derived and/or modified sequence from Lassa virus__AIT17144__Z (opt1)
ggggcgcugccuacggagguggcagccaucuccuucucggcaucaagcuuaccaugggcaacaagcaggccaagacccccgagagcaaggacuccccgcgcgccagccugauccccgacgccacccaccucgggccccaguucugcaaguccugcugguucgagaacaagggccugguggagugcaacaaccacuaccugugccucaacugccugacgcugcuccugggggucagcaaccggugccccaucugcaagaugccgcugcccaccaagcuccgcuccagcguggcccccaccgcgcccccgaccggcgccguggacuccauccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5752 - RNA, 682 nt, Artificial Sequence
  mRNA product Design2 comprising derived and/or modified sequence from Lassa virus__AIT17152__Z (opt1)
ggggcgcugccuacggagguggcagccaucuccuucucggcaucaagcuuaccaugggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccaccgcccccacggccccgcccgccggggccgcggacaacacccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5753 - RNA, 682 nt, Artificial Sequence
  mRNA product Design2 comprising derived and/or modified sequence from Lassa virus__AIT17162__Z (opt1)
ggggcgcugccuacggagguggcagccaucuccuucucggcaucaagcuuaccaugggcaacaagcaggccaaggccagcgaguccaaggacagcccccgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccccugccgacgaagcuccgccccuccgugacccccaccgcgcccccgacccggacggccgacaacacccgcccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5754 - RNA, 682 nt, Artificial Sequence
  mRNA product Design2 comprising derived and/or modified sequence from Lassa virus__AIT17166__Z (opt1)
ggggcgcugccuacggagguggcagccaucuccuucucggcaucaagcuuaccaugggcaacaagcaggccaaggcccccgaggcgaaggacagcccgcgcgccucccugauccccgacgccacccaccucgggccccaguucugcaagagcugcugguucgagaccaagggccugguggagugcaacaaccacuaccugugccucaacugccugacgcugcuccuguccgucagcaaccggugccccaucugcaagaugccgcugcccaccaagcuccgccccuccgccacccccaccgccccgcccacggaggcggccgacagcaucgggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5755 - RNA, 682 nt, Artificial Sequence
  mRNA product Design2 comprising derived and/or modified sequence from Lassa virus__AIT17170__Z (opt1)
ggggcgcugccuacggagguggcagccaucuccuucucggcaucaagcuuaccaugggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccggugccccaucugcaagaugccgcugcccacgaagcuccgccccagcgccgcccccaccgccccgcccgccggggcggccgacuccauccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5756 - RNA, 682 nt, Artificial Sequence
  mRNA product Design2 comprising derived and/or modified sequence from Lassa virus__AIT17174__Z (opt1)
ggggcgcugccuacggagguggcagccaucuccuucucggcaucaagcuuaccaugggcaacaagcagaccaaggcccccgaggccaaggggagcccgcgcgcgucccugauccccgacgccacccaccucggcccccaguucugcaagagcugcugguucgagaacaaggggcugguggagugcaacaaccacuaccugugccucaacugccugacgcugcuccuguccgucagcucccggugccccaucugcaagaugccgcugcccaccaagcuccgccccagcgccgugcccaccgccccgcccaccaaggccgaggacaacacgcggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5757 - RNA, 682 nt, Artificial Sequence
  mRNA product Design2 comprising derived and/or modified sequence from Lassa virus__AIT17178__Z (opt1)
ggggcgcugccuacggagguggcagccaucuccuucucggcaucaagcuuaccaugggcaacaagcaggccaaggccagcgaggcgaaggacagcccccgcgccucccugaucccggacgccacccaccucgggccccaguucugcaaguccugcugguucgagaacaagggccugguggagugcaacaaccacuaccugugccucaacugccugagccugcuccuguccgucagcucccggugccccaucugcaagaugccccugccgacccgccuccggcccagcacggcccccaccgcgcccccggcccgcgccggggacaacaucaagcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5758 - RNA, 682 nt, Artificial Sequence
  mRNA product Design2 comprising derived and/or modified sequence from Lassa virus__AIT17182__Z (opt1)
ggggcgcugccuacggagguggcagccaucuccuucucggcaucaagcuuaccaugggcaacaagcaggccaaggugcccgagguccgcgacagcccccgggccucccugauccccgacgcgacccaccucgggccccaguucugcaagagcugcugguucgagaacaagggccugguggagugcaacaaccacuaccugugccucaacugccugacccugcuccuguccgugagcucccgcugccccaucugcaagaugccgcugcccacgaagcuccggcccagcgccacccccaccgccccgcccgccggggccggcgacgggacccgcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5759 - RNA, 682 nt, Artificial Sequence
  mRNA product Design2 comprising derived and/or modified sequence from Lassa virus__AIT17186__Z (opt1)
ggggcgcugccuacggagguggcagccaucuccuucucggcaucaagcuuaccaugggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccguggcccccaccgccccgcccgccggggccgcggacaacacgcggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5760 - RNA, 682 nt, Artificial Sequence
  mRNA product Design2 comprising derived and/or modified sequence from Lassa virus__AIT17194__Z (opt1)
ggggcgcugccuacggagguggcagccaucuccuucucggcaucaagcuuaccaugggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccguggccccgaccgccccgcccgccgggguggucgacagcacccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5761 - RNA, 682 nt, Artificial Sequence
  mRNA product Design2 comprising derived and/or modified sequence from Lassa virus__AIT17198__Z (opt1)
ggggcgcugccuacggagguggcagccaucuccuucucggcaucaagcuuaccaugggcaacaagcaggccaaggugcccgagagcaaggacuccccgcgcgccagccugauccccgacgcgacccaccucgggccccaguucugcaaguccugcugguucgagaaccgcggccuggucgagugcaacaaccacuaccugugccucaacugccugacccugcuccugagcguguccaaccgcugccccaucugcaagaugccgcugcccacgaagcuccggcccagcaccgcccccaccgccccgcccaccggggccgccgacuccacgcggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5762 - RNA, 682 nt, Artificial Sequence
  mRNA product Design2 comprising derived and/or modified sequence from Lassa virus__AIT17202__Z (opt1)
ggggcgcugccuacggagguggcagccaucuccuucucggcaucaagcuuaccaugggcaacaagcaggccaagacccccgagagcaaggacuccccgcgcgccagccugauccccgacgcgacccaccucgggccccaguucugcaaguccugcugguucgagaacaagggccugguggagugcaacaaccacuaccugugccucaacugccugacgcugcuccugagcgucuccaaccgcugccccaucugcaagaugccgcugcccacccgccuccggcccagcgccgcccccaccgccccgcccuccggggccgcggacagcacccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5763 - RNA, 682 nt, Artificial Sequence
  mRNA product Design2 comprising derived and/or modified sequence from Lassa virus__AIT17206__Z (opt1)
ggggcgcugccuacggagguggcagccaucuccuucucggcaucaagcuuaccaugggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcuaccggugccccaucugcaagaugccgcugcccacgaagcuccgccccuccgccacccccaccgccccgcccaccgaggcggccgacagcauccggcccccgcccuaccgccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5764 - RNA, 682 nt, Artificial Sequence
  mRNA product Design2 comprising derived and/or modified sequence from Lassa virus__AIT17214__Z (opt1)
ggggcgcugccuacggagguggcagccaucuccuucucggcaucaagcuuaccaugggcaacaagcaggccaaggcccccgaggugaaggacagcccgcgcgcgucccugauccccgacgccacccaccucgggccccaguucugcaagagcugcugguucgagaacaagggccuggucgagugcaacaaccacuaccugugccucaacugccugacccugcuccuguccgugagcaaccggugccccaucugcaagaugccgcugcccacgaagcuccgccccuccgccgcccccaccgccccgcccaccgggaccgcggacagcauccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5765 - RNA, 682 nt, Artificial Sequence
  mRNA product Design2 comprising derived and/or modified sequence from Lassa virus__AIT17222__Z (opt1)
ggggcgcugccuacggagguggcagccaucuccuucucggcaucaagcuuaccaugggcaacaagcaggccaagacccccgagaccaaggacagcccccgcgccucccugauccccgacgcgacgcaccucgggccccaguucugcaagagcugcugguucgagaacaagggccugguggagugcaacucccacuaccugugccucaacugccugacccugcuccugagcgucuccagccggugccccaucugcaagaugccgcugcccacccgccuccggcccuccaccgcccccacggccccgcccgccggggugggcgacagcaccuccccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5766 - RNA, 682 nt, Artificial Sequence
  mRNA product Design2 comprising derived and/or modified sequence from Lassa virus__AIT17226__Z (opt1)
ggggcgcugccuacggagguggcagccaucuccuucucggcaucaagcuuaccaugggcaacaagcaggccaagacccccgaggccaaggacagcccccgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccacccccaccgccccgcccgccggggcggccgacagcaucggcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5767 - RNA, 679 nt, Artificial Sequence
  mRNA product Design2 comprising derived and/or modified sequence from Lassa virus__AIT17230__Z (opt1)
ggggcgcugccuacggagguggcagccaucuccuucucggcaucaagcuuaccaugggcaacaagcaggccaaggccagcgacaagaacagcccccgcgcgucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcgccacccccaccgcgcccccgaccggggccgccgacuccauccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5768 - RNA, 682 nt, Artificial Sequence
  mRNA product Design2 comprising derived and/or modified sequence from Lassa virus__AIT17234__Z (opt1)
ggggcgcugccuacggagguggcagccaucuccuucucggcaucaagcuuaccaugggcaacaagcaggccaaggccagcgaggagaagaacagcccccgcgcgucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcgccacccccaccgcgcccccgaccggggccgccgacuccauccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5769 - RNA, 682 nt, Artificial Sequence
  mRNA product Design2 comprising derived and/or modified sequence from Lassa virus__AIT17238__Z (opt1)
ggggcgcugccuacggagguggcagccaucuccuucucggcaucaagcuuaccaugggcaacaagcagaccaaggcccccgaggccaaggggagcccgcgcgcgucccugauccccgacgccacccaccucggcccccaguucugcaagagcugcugguucgagaacaaggggcugguggagugcaacaaccacuaccugugccucaacugccugacgcugcuccuguccgucagcaaccggugccccaucugcaagaugccgcugcccaccaagcuccgccccuccgccacccccaccgccccgcccacggaggccgcggacagcauccggcccccgcccuaccgccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5770 - RNA, 682 nt, Artificial Sequence
  mRNA product Design2 comprising derived and/or modified sequence from Lassa virus__AIT17242__Z (opt1)
ggggcgcugccuacggagguggcagccaucuccuucucggcaucaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgcgccuccggcccagcgccgcccccaccgccccgcccaccggggcgaccgacuccacgcggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5771 - RNA, 682 nt, Artificial Sequence
  mRNA product Design2 comprising derived and/or modified sequence from Lassa virus__AIT17248__Z (opt1)
ggggcgcugccuacggagguggcagccaucuccuucucggcaucaagcuuaccaugggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagacgccgcugcccacccggcuccgccccuccgccacccccaccgccccgcccgccggcgcgggggacaacacgcggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5772 - RNA, 682 nt, Artificial Sequence
  mRNA product Design2 comprising derived and/or modified sequence from Lassa virus__AIT17252__Z (opt1)
ggggcgcugccuacggagguggcagccaucuccuucucggcaucaagcuuaccaugggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccgcugcccacgaagcuccgccccuccaccgcccccaccgccccgcccgcgggggccgccgacagcacccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5773 - RNA, 682 nt, Artificial Sequence
  mRNA product Design2 comprising derived and/or modified sequence from Lassa virus__AIT17256__Z (opt1)
ggggcgcugccuacggagguggcagccaucuccuucucggcaucaagcuuaccaugggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgugggggcggccgacaacacccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5774 - RNA, 682 nt, Artificial Sequence
  mRNA product Design2 comprising derived and/or modified sequence from Lassa virus__AIT17260__Z (opt1)
ggggcgcugccuacggagguggcagccaucuccuucucggcaucaagcuuaccaugggcaacaagcaggccaaggcccccgagcugaaggacagcccgcgcgcgucccucauccccgacgccacccaccuggggccccaguucugcaagagcugcugguucgagaacaagggccugguggagugcaacaaccacuaccucugccugaacugccugacccuccugcuguccgucagcaaccggugccccaucugcaagaugccgcuccccacgaagcugcgccccuccgccgcccccaccgccccgcccgcgggggccguggacagcacccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5775 - RNA, 682 nt, Artificial Sequence
  mRNA product Design2 comprising derived and/or modified sequence from Lassa virus__AIT17268__Z (opt1)
ggggcgcugccuacggagguggcagccaucuccuucucggcaucaagcuuaccaugggcaacaagcagaccaaggcccccgaggugaaggggagcccccgcgccucccugauccccgacgcgacccaccucggcccccaguucugcaagagcugcugguucgagaacaaggggcuggucgagugcaacaaccacuaccugugccucaacugccugacgcugcuccuguccgugagcaaccggugccccaucugcaagaugccgcugcccaccaagcucaagcccuccaccacccccacggccccgcccaccggcgccgccgacagcauccgcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5776 - RNA, 682 nt, Artificial Sequence
  mRNA product Design2 comprising derived and/or modified sequence from Lassa virus__AIT17272__Z (opt1)
ggggcgcugccuacggagguggcagccaucuccuucucggcaucaagcuuaccaugggcaacaagcaggucaagaccagcgaggcccgcgacagcccccgggccucccugaucccggacgccaccgaccucgggccccaguucugcaaguccugcugguucgagaacaagggccugguggagugcaacaaccacuaccugugccucaacugccugacgcugcuccugagcguguccaaccgcugccccaucugcaagaugccccugccgacccggcuccgccccagcgccaaccccaccgcgcccccggccgagaccggggacuccacgcggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5777 - RNA, 682 nt, Artificial Sequence
  mRNA product Design2 comprising derived and/or modified sequence from Lassa virus__AIT17278__Z (opt1)
ggggcgcugccuacggagguggcagccaucuccuucucggcaucaagcuuaccaugggcagcaagcagaccaagacccccgaggugaaggacuccccgcgcgccagccugauccccgacgccacgcaccucgggccccaguucugcaaguccugcugguucgagaacaagggccuggucgagugcaacaaccacuaccugugccucaacugccugacccugcuccugagcguguccaaccgcugccccaucugcaagaugccgcugcccaccaagcuccgccccagcgcggcccccaccgccccgcccgcccgggccgcggacgacacgcggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5778 - RNA, 682 nt, Artificial Sequence
  mRNA product Design2 comprising derived and/or modified sequence from Lassa virus__AIT17282__Z (opt1)
ggggcgcugccuacggagguggcagccaucuccuucucggcaucaagcuuaccaugggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccgccgccccgaccgccccgcccgcgggggccguggacagcauccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5779 - RNA, 682 nt, Artificial Sequence
  mRNA product Design2 comprising derived and/or modified sequence from Lassa virus__AIT17286__Z (opt1)
ggggcgcugccuacggagguggcagccaucuccuucucggcaucaagcuuaccaugggcaacaagcagaccaaggcccccgaggugaaggacagcccgcgcgccucccugauccccgacgcgacccaccucgggccccaguucugcaagagcugcugguucgagaacaagggccuggucgagugcaacaaccacuaccugugccucaacugccugacgcugcuccuguccgugagcaaccggugccccaucugcaagaugccgcugcccaccaagcuccgccccuccaccgcccccaccgccccgcccgccgggacgauggacagcacccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5780 - RNA, 682 nt, Artificial Sequence
  mRNA product Design2 comprising derived and/or modified sequence from Lassa virus__AIT17290__Z (opt1)
ggggcgcugccuacggagguggcagccaucuccuucucggcaucaagcuuaccaugggcaacaagcaggcccgcgcccccgaggcgaaggacagcccgcgggccucccugauccccgacgccacccaccucgggccccaguucugcaagagcugcugguucgagaacaagggccugguggagugcaacaaccacuaccugugccucaacugccugacccugcuccuguccgucagcucccgcugccccaucugcaagaugccgcugcccacgcggcuccgccccagcgccauccccaccgccccgcccgcggggaccggcgacuccagccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5781 - RNA, 682 nt, Artificial Sequence
  mRNA product Design2 comprising derived and/or modified sequence from Lassa virus__AIT17296__Z (opt1)
ggggcgcugccuacggagguggcagccaucuccuucucggcaucaagcuuaccaugggcaacaagcaggccaagacccccgagaucaaggacagcccgcgcgccucccugauccccgacgcgacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgccggggcggccgacaucacccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5782 - RNA, 682 nt, Artificial Sequence
  mRNA product Design2 comprising derived and/or modified sequence from Lassa virus__AIT17300__Z (opt1)
ggggcgcugccuacggagguggcagccaucuccuucucggcaucaagcuuaccaugggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagaugccgcugcccacgcggcuccgccccuccaccgcccccaccgccccgcccgccggcgcgggggacaacacccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5783 - RNA, 682 nt, Artificial Sequence
  mRNA product Design2 comprising derived and/or modified sequence from Lassa virus__AIT17312__Z (opt1)
ggggcgcugccuacggagguggcagccaucuccuucucggcaucaagcuuaccaugggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccgccgcccccaccgccccgcccgugggggccgcggacagcacgcggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5784 - RNA, 682 nt, Artificial Sequence
  mRNA product Design2 comprising derived and/or modified sequence from Lassa virus__AIT17316__Z (opt1)
ggggcgcugccuacggagguggcagccaucuccuucucggcaucaagcuuaccaugggcaacaagcaggccaaggcccccgaggcgcgcaacagcccccgggccucccugauccccgacgccacccaccucgggccccaguucugcaagagcugcugguucgagaaccgcggccugguggagugcaacaaccacuaccugugccucaacugccugacccugcuccuguccgucagcucccggugccccaucugcaagaugccgcugcccacgcgccuccggcccagcgccgcccccaccgcgccgcccgccggggccggcgacaacacccgcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5785 - RNA, 682 nt, Artificial Sequence
  mRNA product Design2 comprising derived and/or modified sequence from Lassa virus__AIT17320__Z (opt1)
ggggcgcugccuacggagguggcagccaucuccuucucggcaucaagcuuaccaugggcaacaagcaggccaaggcccccgaggcgcgcaacagcccgcgggccucccugauccccgacgccacccaccucgggccccaguucugcaagagcugcugguucgagaacaagggccugguggagugcaacaaccacuaccugugccucaacugccugacccugcuccugggggucuccagccgcugccccaucugcaagaugccgcugcccacgcggcuccgccccuccgccgcccccaccgcgccgcuggccgaggccggcgacaacacccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5786 - RNA, 682 nt, Artificial Sequence
  mRNA product Design2 comprising derived and/or modified sequence from Lassa virus__AIT17326__Z (opt1)
ggggcgcugccuacggagguggcagccaucuccuucucggcaucaagcuuaccaugggcaacaagcagagcaaggcccccgagucccgcgacagcccgcgggccucccugauccccgacgcgacccaccucgggccccaguucugcaagagcugcugguucgagaacaagggccugguggagugcaacaaccacuaccugugccucaacugccugacccugcuccuguccgucagcaaccgcugccccaucugcaagaugccgcugcccacgaagcuccggcccuccgccacccccaccgccccgcccacccgcgccgccgacagcauccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5787 - RNA, 682 nt, Artificial Sequence
  mRNA product Design2 comprising derived and/or modified sequence from Lassa virus__AIT17330__Z (opt1)
ggggcgcugccuacggagguggcagccaucuccuucucggcaucaagcuuaccaugggcaacaagcaggccaaggcccuggagagcaagaacagcccccgcgcgucccucauccccgacgccaccuaccuggggccccaguucugcaaguccugcugguucgagaacaagggccugguggagugcaacaaccacuaccucugccugaacugccugacccuccugcugagcgucuccaaccggugccccaucugcaagaugccccucccgacgaagcugcgcagcuccgccgcccccaccgccccgcccaccggggcggccgacggcaccaagcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5788 - RNA, 682 nt, Artificial Sequence
  mRNA product Design2 comprising derived and/or modified sequence from Lassa virus__AIT17342__Z (opt1)
ggggcgcugccuacggagguggcagccaucuccuucucggcaucaagcuuaccaugggcaacaagcaggccaaggccagcgaggcgaaggacagcccccgcgccucccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcaccgcccccaccgcgccccagaccggggccgccgacuccauccggccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5789 - RNA, 682 nt, Artificial Sequence
  mRNA product Design2 comprising derived and/or modified sequence from Lassa virus__AIT17346__Z (opt1)
ggggcgcugccuacggagguggcagccaucuccuucucggcaucaagcuuaccaugggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgugggggcggccgacagcacccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5790 - RNA, 682 nt, Artificial Sequence
  mRNA product Design2 comprising derived and/or modified sequence from Lassa virus__AIT17362__Z (opt1)
ggggcgcugccuacggagguggcagccaucuccuucucggcaucaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccgcugcccacgaagcuccgccccagcgccgcccccaccgccccgcccgcgggggccgccgacuccauccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5791 - RNA, 682 nt, Artificial Sequence
  mRNA product Design2 comprising derived and/or modified sequence from Lassa virus__AIT17366__Z (opt1)
ggggcgcugccuacggagguggcagccaucuccuucucggcaucaagcuuaccaugggcaacaagcagaccaagacccccgaggugaaggacagcccccgcgccucccugauccccgacgccacgcaccucgggccccaguucugcaagagcugcugguucgagaacaagggccuggucgagugcaacaaccacuaccugugccucaacugccugacccugcuccuguccgugagcaaccggugccccaucugcaagaugccgcugcccaccaagcuccgccccuccgcggcccccaccgccccgcccgcccgggccgcggacgacacgcgcccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5792 - RNA, 682 nt, Artificial Sequence
  mRNA product Design2 comprising derived and/or modified sequence from Lassa virus__AIT17376__Z (opt1)
ggggcgcugccuacggagguggcagccaucuccuucucggcaucaagcuuaccaugggcaacaagcaggccaaggcccccgagagcaaggacuccccgcgcgcgagccugauccccgacgccaccuaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgaagcuccgcagcuccguggcccccaccgcgcccccgacccgggccgccgacagcacccggcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5793 - RNA, 682 nt, Artificial Sequence
  mRNA product Design2 comprising derived and/or modified sequence from Lassa virus__AIT17382__Z (opt1)
ggggcgcugccuacggagguggcagccaucuccuucucggcaucaagcuuaccaugggcaacaagcagaccaagaccagcgaggugaaggacagcccccgcgccucccugauccccgacgccacgcaccucgggccccaguucugcaaguccugcugguucgagaacaagggccuggucgagugcaacaaccacuaccugugccucaacugccugacccugcuccugagcguguccaaccggugccccaucugcaagaugccccugccgaccaagcuccgccccagcgcggcccccaccgcgcccccggcccgggccgccgacgacacgcgcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5794 - RNA, 682 nt, Artificial Sequence
  mRNA product Design2 comprising derived and/or modified sequence from Lassa virus__AIT17386__Z (opt1)
ggggcgcugccuacggagguggcagccaucuccuucucggcaucaagcuuaccaugggcaacaagcaggccaagacccccgaggcccgcgacagcccccgggcgucccugauccccgacgccacccaccucgggccccaguucugcaagagcugcugguucgagaacaagggccugguggagugcaacaaccacuaccugugccucaacugccugacgcugcuccuguccgucagcucccgcugccccaucugcaagaugccgcugcccaccaagcuccggcccagcgccacccccaccgccccgcccgccggggcgggcgacgggacgcgcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5795 - RNA, 682 nt, Artificial Sequence
  mRNA product Design2 comprising derived and/or modified sequence from Lassa virus__AIT17396__Z (opt1)
ggggcgcugccuacggagguggcagccaucuccuucucggcaucaagcuuaccaugggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagaugccgcugcccacgcggcuccgccccuccgccgcccccaccgccccgcccgcggaggccggcgacaacacccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5796 - RNA, 682 nt, Artificial Sequence
  mRNA product Design2 comprising derived and/or modified sequence from Lassa virus__AIT17402__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggagaccauccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5797 - RNA, 682 nt, Artificial Sequence
  mRNA product Design2 comprising derived and/or modified sequence from Lassa virus__AIT17406__Z (opt1)
ggggcgcugccuacggagguggcagccaucuccuucucggcaucaagcuuaccaugggcaaccgccaggccaagagcuccaagguggacgagcaccagcgggcccaccugguccccgacgcgagccaccucgggccccaguucugcaaguccugcugguucgagaacaagggccugguggagugcaacaaccacuaccugugccucaacugccugagccugcuccuguccgugagcucccgcugccccaucugcaagaugccccugcccaccaagcucaaggccgccgcccagccgagcgcccccuccaccgaggcgguccagaacacggccccgccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5798 - RNA, 682 nt, Artificial Sequence
  mRNA product Design2 comprising derived and/or modified sequence from Lassa virus__AIT17410__Z (opt1)
ggggcgcugccuacggagguggcagccaucuccuucucggcaucaagcuuaccaugggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5799 - RNA, 682 nt, Artificial Sequence
  mRNA product Design2 comprising derived and/or modified sequence from Lassa virus__AIT17418__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgagaccauccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5800 - RNA, 682 nt, Artificial Sequence
  mRNA product Design2 comprising derived and/or modified sequence from Lassa virus__AIT17422__Z (opt1)
ggggcgcugccuacggagguggcagccaucuccuucucggcaucaagcuuaccaugggcaaccgccaggccaagagcgccaagguggacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacccagccguccgcccccagcacggaggcgacccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5801 - RNA, 682 nt, Artificial Sequence
  mRNA product Design2 comprising derived and/or modified sequence from Lassa virus__AIT17426__Z (opt1)
ggggcgcugccuacggagguggcagccaucuccuucucggcaucaagcuuaccaugggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccacgcagccguccgcccccagcaccgaggccacccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5802 - RNA, 682 nt, Artificial Sequence
  mRNA product Design2 comprising derived and/or modified sequence from Lassa virus__AIT17432__Z (opt1)
ggggcgcugccuacggagguggcagccaucuccuucucggcaucaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccaucccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5803 - RNA, 682 nt, Artificial Sequence
  mRNA product Design2 comprising derived and/or modified sequence from Lassa virus__AIT17436__Z (opt1)
ggggcgcugccuacggagguggcagccaucuccuucucggcaucaagcuuaccaugggcaacaagcaggccaagagcaccaaggccgacgagcaccagcgcgcgcaccuggugcccgacgccucccaccucgggccgcaguucugcaagagcugcugguucgagaaccggggccuggucgagugcaacaaccacuaccugugccucaacugccugucccugcuccugagcguguccagccgcugccccaucugcaagaugccccugcccaccaagcucaaggccgccacgcagccguccgcccccagcaccgaggcgacccggaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5804 - RNA, 682 nt, Artificial Sequence
  mRNA product Design2 comprising derived and/or modified sequence from Lassa virus__AIT17444__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccgccgcccagccguccgcccccagcacggaggcggcccagaacaccgccccgccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5805 - RNA, 682 nt, Artificial Sequence
  mRNA product Design2 comprising derived and/or modified sequence from Lassa virus__AIT17448__Z (opt1)
ggggcgcugccuacggagguggcagccaucuccuucucggcaucaagcuuaccaugggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccacggcccagccguccgcccccagcgccgaggcgauccagaacaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5806 - RNA, 682 nt, Artificial Sequence
  mRNA product Design2 comprising derived and/or modified sequence from Lassa virus__AIT17452__Z (opt1)
ggggcgcugccuacggagguggcagccaucuccuucucggcaucaagcuuaccaugggcaaccgccaggccaagagcacccggguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccacccggcuccgcgccgccguccagccguccgcccccagcacggagaccacccaggacaccacgcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5807 - RNA, 682 nt, Artificial Sequence
  mRNA product Design2 comprising derived and/or modified sequence from Lassa virus__AIT17456__Z (opt1)
ggggcgcugccuacggagguggcagccaucuccuucucggcaucaagcuuaccaugggcaaccgccaggccaagagcaccgaggugaacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccgugcccccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5808 - RNA, 682 nt, Artificial Sequence
  mRNA product Design2 comprising derived and/or modified sequence from Lassa virus__AIT17460__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagcccuccgccccgcccacggaggcgacccagaacaccacgccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5809 - RNA, 682 nt, Artificial Sequence
  mRNA product Design2 comprising derived and/or modified sequence from Lassa virus__AIT17468__Z (opt1)
ggggcgcugccuacggagguggcagccaucuccuucucggcaucaagcuuaccaugggcaaccgccaggccaagcagaccaagguggacgagcaccagcgggcccaccugguccccgacgcgagccaccucgggccccaguucugcaaguccugcugguucgagaaccgcggccugguggagugcaacaaccacuaccugugccucaacugccugagccugcuccuguccaucagcucccggugccccaucugcaagaugccccugcccaccaagcucaaggccgccgcccagccgagcgcccccuccacggaggcgacccaggacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5810 - RNA, 682 nt, Artificial Sequence
  mRNA product Design2 comprising derived and/or modified sequence from Lassa virus__AIT17472__Z (opt1)
ggggcgcugccuacggagguggcagccaucuccuucucggcaucaagcuuaccaugggcaacaagcagaccaagagcaccaaggccgacgagcaccagcgcgcccaccuggugcccgacgcgucccaccucgggccgcaguucugcaagagcugcugguucgagaaccggggccuggucgagugcaacaaccacuaccugugccucaacugccugucccugcuccugagcguguccagccgcugccccaucugcaagaugccccugcccacgcggcucaaggccgccgcccagccguccgcccccagcaccgaggcgacccaggacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5811 - RNA, 682 nt, Artificial Sequence
  mRNA product Design2 comprising derived and/or modified sequence from Lassa virus__AIT17476__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcgcggaggccauccagaacacgaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5812 - RNA, 682 nt, Artificial Sequence
  mRNA product Design2 comprising derived and/or modified sequence from Lassa virus__AIT17480__Z (opt1)
ggggcgcugccuacggagguggcagccaucuccuucucggcaucaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggucauccaguccaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5813 - RNA, 682 nt, Artificial Sequence
  mRNA product Design2 comprising derived and/or modified sequence from Lassa virus__AIT17484__Z (opt1)
ggggcgcugccuacggagguggcagccaucuccuucucggcaucaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggagauccagaacaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5814 - RNA, 682 nt, Artificial Sequence
  mRNA product Design2 comprising derived and/or modified sequence from Lassa virus__AIT17488__Z (opt1)
ggggcgcugccuacggagguggcagccaucuccuucucggcaucaagcuuaccaugggcaaccgccaggccaagcccaccaagguggacgagcaccagcgggcccaccuggucccggacgccagccaccucgggccccaguucugcaaguccugcugguucgagaacaagggccugguggagugcaacaaccacuaccugugccucaacugccugagccugcuccuguccgugagcucccgcugccccaucugcaagaugccccugccgaccaagcucaaggccgccgcccagcccagcgcccccuccacggaggcggcccagaacaccgcgcccccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5815 - RNA, 682 nt, Artificial Sequence
  mRNA product Design2 comprising derived and/or modified sequence from Lassa virus__AIT17496__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccacccgccucaaggccgccacgcagccguccgcccccagcaccgaggccacccagaccacgaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5816 - RNA, 682 nt, Artificial Sequence
  mRNA product Design2 comprising derived and/or modified sequence from Lassa virus__AIT17500__Z (opt1)
ggggcgcugccuacggagguggcagccaucuccuucucggcaucaagcuuaccaugggcaaccgccagaccaagagcaccaagguggacgagcaccagcgggcccaccugguccccgacgccucccaccucgggccccaguucugcaagagcugcugguucgagaacaagggccugguggagugcaacaaccacuaccugugccucaacugccugucccugcuccugagcguguccagccgcugccccaucugcaagaugccccugcccacgaagcucaagaccgcggcccagccguccgccccgcccaccgaggccgcccggaccacggcgcccccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5817 - RNA, 682 nt, Artificial Sequence
  mRNA product Design2 comprising derived and/or modified sequence from Lassa virus__AIT17508__Z (opt1)
ggggcgcugccuacggagguggcagccaucuccuucucggcaucaagcuuaccaugggcaaccgccagaccaagagcaccaagguggacgagcaccagcgggcccaccugguccccgacgccucccaccucgggccgcaguucugcaagagcugcugguucgagaacaagggccugguggagugcaacaaccacuaccugugccucaacugccugucccugcuccugagcguguccagccgcugccccaucugcaagaugccccugcccacgaagcucaaggcggccgcccagccguccgcccccagcaccgaggccacccagaacaccgcgcccccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5818 - RNA, 682 nt, Artificial Sequence
  mRNA product Design2 comprising derived and/or modified sequence from Lassa virus__AIT17512__Z (opt1)
ggggcgcugccuacggagguggcagccaucuccuucucggcaucaagcuuaccaugggcaaccgccaggccaagagcaccaagguguacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccacccgccucaaggccgccacgcagccguccgcccccagcaccgaggccacccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5819 - RNA, 682 nt, Artificial Sequence
  mRNA product Design2 comprising derived and/or modified sequence from Lassa virus__AIT17516__Z (opt1)
ggggcgcugccuacggagguggcagccaucuccuucucggcaucaagcuuaccaugggcaaccgccaggccaagagcaccaagguggacgagcaccagcgggcccaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaagacggccacccagccguccgcgccccugaccgaggccacccagaacacgaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5820 - RNA, 682 nt, Artificial Sequence
  mRNA product Design2 comprising derived and/or modified sequence from Lassa virus__AIT17520__Z (opt1)
ggggcgcugccuacggagguggcagccaucuccuucucggcaucaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccaaccgcugccccaucugcaagaugccccugcccaccaagcucaaggccgccgcccagccgagcgcccccuccacggaggcgacccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5821 - RNA, 682 nt, Artificial Sequence
  mRNA product Design2 comprising derived and/or modified sequence from Lassa virus__AIT17526__Z (opt1)
ggggcgcugccuacggagguggcagccaucuccuucucggcaucaagcuuaccaugggcaaccgccaggccaagagcgccaaggugaccgagcaccagcgggcccaccugguccccgacgccucccaccucgggccgcaguucugcaagagcugcugguucgagaacaagggccugguggagugcaacaaccacuaccugugccucaacugccugucccugcuccugagcguguccagccgcugccccaucugcaagaugccccugcccacccggcucaaggccgccacccagccguccgcccccagcgcggaggcgccccaguccaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5822 - RNA, 682 nt, Artificial Sequence
  mRNA product Design2 comprising derived and/or modified sequence from Lassa virus__AIT17536__Z (opt1)
ggggcgcugccuacggagguggcagccaucuccuucucggcaucaagcuuaccaugggcaaccgccagacccggcccaccgaggccacggagcagagccgcgcccaccuggugccggacgccucccaccucgggccccaguucugcaagagcugcugguucgagaacaagggccuggucgagugcaacaaccacuaccugugccucaacugccugucccugcuccugagcguguccagccggugccccaucugcaagaugccccugccgacccgccucaaggccuccgcccagcccagcgccccgcccaccgaggcgccccagaacaaggcgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5823 - RNA, 682 nt, Artificial Sequence
  mRNA product Design2 comprising derived and/or modified sequence from Lassa virus__AIT17542__Z (opt1)
ggggcgcugccuacggagguggcagccaucuccuucucggcaucaagcuuaccaugggcaaccgccaggucaagagcaccaagguggacgagcaccagcgggcccaccugauccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucgaggcggccgcccagccguccgcccccagcacggaggccacccaggacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5824 - RNA, 682 nt, Artificial Sequence
  mRNA product Design2 comprising derived and/or modified sequence from Lassa virus__AIT17546__Z (opt1)
ggggcgcugccuacggagguggcagccaucuccuucucggcaucaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccgcccagccguccgcccccagcacggagaccauccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5825 - RNA, 682 nt, Artificial Sequence
  mRNA product Design2 comprising derived and/or modified sequence from Lassa virus__AIT17550__Z (opt1)
ggggcgcugccuacggagguggcagccaucuccuucucggcaucaagcuuaccaugggcaaccgccaggccaagcagaccaagguggacgagcaccagcgggcccaccugguccccgacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugcccaccaagcucaaggccgccgcccagccgagcgcccccuccacggagaucacccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5826 - RNA, 682 nt, Artificial Sequence
  mRNA product Design2 comprising derived and/or modified sequence from Lassa virus__AIT17554__Z (opt1)
ggggcgcugccuacggagguggcagccaucuccuucucggcaucaagcuuaccaugggcaaccgccaggccaagagcaccaaggccgacgagcaccagcgggcgcaccuggugcccgacgccucccaccucgggccccaguucugcaagagcugcugguucgagaaccgcggccuggucgagugcaacaaccacuaccugugccucaacugccugucccugcuccugagcguguccaaccggugccccaucugcaagaugccccugcccacccgccucaaggccgccgcccagccgagcgcgcccuccacggaggccacccaggacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5827 - RNA, 682 nt, Artificial Sequence
  mRNA product Design2 comprising derived and/or modified sequence from Lassa virus__AIT17558__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccacccgccucaaggccgccgcccagccguccgcccccagcacggaggcgauccgguccaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5828 - RNA, 682 nt, Artificial Sequence
  mRNA product Design2 comprising derived and/or modified sequence from Lassa virus__AIT17570__Z (opt1)
ggggcgcugccuacggagguggcagccaucuccuucucggcaucaagcuuaccaugggcaaccgccaggccaagagcgccaaggugaacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcgcccagcaccgaggccacgcagaacaucaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5829 - RNA, 682 nt, Artificial Sequence
  mRNA product Design2 comprising derived and/or modified sequence from Lassa virus__AIT17578__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcuccgggccgccgcccagccguccgcccccagcacggaguccgcgcagaacaccgccccgccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5830 - RNA, 682 nt, Artificial Sequence
  mRNA product Design2 comprising derived and/or modified sequence from Lassa virus__AIT17586__Z (opt1)
ggggcgcugccuacggagguggcagccaucuccuucucggcaucaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccacccggcucaaggccgccgcccagccguccgcccccagcacggaggucacccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5831 - RNA, 682 nt, Artificial Sequence
  mRNA product Design2 comprising derived and/or modified sequence from Lassa virus__AIT17590__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucgaggccacgacccagccguccgcccccagcaccgaggagacccaguccacgaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5832 - RNA, 682 nt, Artificial Sequence
  mRNA product Design2 comprising derived and/or modified sequence from Lassa virus__AIT17602__Z (opt1)
ggggcgcugccuacggagguggcagccaucuccuucucggcaucaagcuuaccaugggcaacaagcaggccaagagcaccaagguggacgaguaccagcgcgcccaccugguccccgacgcgucccaccucgggccccaguucugcaagagcugcugguucgagaaccggggccugguggagugcaacaaccacuaccugugccucaacugccugucccugcuccugagcguguccaaccgcugccccaucugcaagaugccccugcccacccggcucaaggccgccgcccagcccagcgccccgcccacggaggcgacccagaacaccacgccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5833 - RNA, 682 nt, Artificial Sequence
  mRNA product Design2 comprising derived and/or modified sequence from Lassa virus__AIT17610__Z (opt1)
ggggcgcugccuacggagguggcagccaucuccuucucggcaucaagcuuaccaugggcaaccgccaggccaagcccaccaagguggacgagcaccagcgggcccagcuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgaccaagcucaaggccgccacgcagcccagcgcccccuccaccgaggccacccagaacagcacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5834 - RNA, 682 nt, Artificial Sequence
  mRNA product Design2 comprising derived and/or modified sequence from Lassa virus__AIT17614__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggccacccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5835 - RNA, 682 nt, Artificial Sequence
  mRNA product Design2 comprising derived and/or modified sequence from Lassa virus__AIT17618__Z (opt1)
ggggcgcugccuacggagguggcagccaucuccuucucggcaucaagcuuaccaugggcaaccgccaggccaagagcaccgagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccaaccggugccccaucugcaagaugccccugcccaccaagcucaaggccgccacgcagccgagcgcccccuccaccgaggccacccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5836 - RNA, 682 nt, Artificial Sequence
  mRNA product Design2 comprising derived and/or modified sequence from Lassa virus__AIT17622__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccaucccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5837 - RNA, 682 nt, Artificial Sequence
  mRNA product Design2 comprising derived and/or modified sequence from Lassa virus__AIT17628__Z (opt1)
ggggcgcugccuacggagguggcagccaucuccuucucggcaucaagcuuaccaugggcaacaagcaggccaagagcaccaagaucgacgagcaccagcgcgcccaccuggugcccgacgcgucccaccucgggccgcaguucugcaagagcugcugguucgagaaccggggccuggucgagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5838 - RNA, 682 nt, Artificial Sequence
  mRNA product Design2 comprising derived and/or modified sequence from Lassa virus__AIT17632__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcuccgggccacggcccagccguccgcccccagcaccgaggccauccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5839 - RNA, 682 nt, Artificial Sequence
  mRNA product Design2 comprising derived and/or modified sequence from Lassa virus__AIT17636__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcaucgagacgauccagaacaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5840 - RNA, 682 nt, Artificial Sequence
  mRNA product Design2 comprising derived and/or modified sequence from Lassa virus__AIT17640__Z (opt1)
ggggcgcugccuacggagguggcagccaucuccuucucggcaucaagcuuaccaugggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccgccgcccagccguccgcccccagcacggaggcgacccaggacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5841 - RNA, 682 nt, Artificial Sequence
  mRNA product Design2 comprising derived and/or modified sequence from Lassa virus__AIT17648__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccgcaguucugcaagagcugcugguucgagaacaagggccugguggagugcaacaaccacuaccugugccucaacugccugucccugcuccugagcguguccagccgcugccccaucugcaagaugccccugcccaccaagcucaaggccacgguccagccguccgcccccagcaccgaggccgcccaguccaccgcgcccccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5842 - RNA, 682 nt, Artificial Sequence
  mRNA product Design2 comprising derived and/or modified sequence from Lassa virus__AIT17652__Z (opt1)
ggggcgcugccuacggagguggcagccaucuccuucucggcaucaagcuuaccaugggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccgccgcccagccguccgcccccagcgcggaggccauccagaagacgaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5843 - RNA, 682 nt, Artificial Sequence
  mRNA product Design2 comprising derived and/or modified sequence from Lassa virus__AIT17656__Z (opt1)
ggggcgcugccuacggagguggcagccaucuccuucucggcaucaagcuuaccaugggcaaccgccaggccaagagcaccaagguggacgaccaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcggcccaggacaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5844 - RNA, 682 nt, Artificial Sequence
  mRNA product Design2 comprising derived and/or modified sequence from Lassa virus__AIT17660__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccaaccggugccccaucugcaagaugccccugcccaccaagcucaaggccgccgcccagccgagcgcccccuccacggaggcgauccagaacaccaccccgccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5845 - RNA, 682 nt, Artificial Sequence
  mRNA product Design2 comprising derived and/or modified sequence from Lassa virus__AIT17664__Z (opt1)
ggggcgcugccuacggagguggcagccaucuccuucucggcaucaagcuuaccaugggcaacaagcaggccaagagcaccaagguggacgagcaccagcgcgcccaccugguccccgacgcgucccaccucgggccccaguucugcaagagcugcugguucgagaacaagggccugguggagugcaacaaccacuaccugugccucaacugccugucccugcuccugagcguguccagccggugccccaucugcaagaugccccugcccaccaagcucaaggccgccgcccagccguccgcccccagcacggaggcggcccagaacaccgccccgccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5846 - RNA, 682 nt, Artificial Sequence
  mRNA product Design2 comprising derived and/or modified sequence from Lassa virus__AIT17668__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaagacgaccgcccagccguccgccccgcccaccgaggccgccaagaacaccgcgcccccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5847 - RNA, 682 nt, Artificial Sequence
  mRNA product Design2 comprising derived and/or modified sequence from Lassa virus__AIT17676__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5848 - RNA, 682 nt, Artificial Sequence
  mRNA product Design2 comprising derived and/or modified sequence from Lassa virus__AIT17680__Z (opt1)
ggggcgcugccuacggagguggcagccaucuccuucucggcaucaagcuuaccaugggcaaccgccaggccaagagcaccaagaucgacgagcaccagcgggcccaccuggugcccgacgcgucccaccucgggccccaguucugcaagagcugcugguucgagaaccgcggccuggucgagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5849 - RNA, 682 nt, Artificial Sequence
  mRNA product Design2 comprising derived and/or modified sequence from Lassa virus__AIT17684__Z (opt1)
ggggcgcugccuacggagguggcagccaucuccuucucggcaucaagcuuaccaugggcaaccgccaggccaagagcgccaagguggacgagcaccagcgggcgcaccugguccccgacgccucccaccucgggccccaguucugcaagagcugcugguucgagaacaagggccugguggagugcaacaaccacuaccugugccucaacugccugucccugcuccugagcguguccugccgcugccccaucugcaagaugccccugcccaccaagcucaaggccgccacccagccgagcgcccccuccacggaggcgacccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5850 - RNA, 682 nt, Artificial Sequence
  mRNA product Design2 comprising derived and/or modified sequence from Lassa virus__AIT17692__Z (opt1)
ggggcgcugccuacggagguggcagccaucuccuucucggcaucaagcuuaccaugggcaaccgccacgccaagcccaccaagguggacgagcaccagcgggcccaccuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgaccaagcucaaggccgccgcccagcccagcgcccccuccaccgaggcgauccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5851 - RNA, 682 nt, Artificial Sequence
  mRNA product Design2 comprising derived and/or modified sequence from Lassa virus__AIT17702__Z (opt1)
ggggcgcugccuacggagguggcagccaucuccuucucggcaucaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcguuccagaacaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5852 - RNA, 682 nt, Artificial Sequence
  mRNA product Design2 comprising derived and/or modified sequence from Lassa virus__AIT17708__Z (opt1)
ggggcgcugccuacggagguggcagccaucuccuucucggcaucaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggccauccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5853 - RNA, 682 nt, Artificial Sequence
  mRNA product Design2 comprising derived and/or modified sequence from Lassa virus__AIT17716__Z (opt1)
ggggcgcugccuacggagguggcagccaucuccuucucggcaucaagcuuaccaugggcaaccgccccgccaagagcaccaagguggacgagcaccagcgggcccaccuggucccggacgcgucccaccucgggccccaguucugcaagagcugcugguucgagaaccgcggccugguggagugcaacaaccacuaccugugccucaacugccugucccugcuccugagcguguccagccggugccccaucugcaagaugccccugccgaccaagcucaaggccgccgcccagcccuccgcccccagcacggaggcgacccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5854 - RNA, 682 nt, Artificial Sequence
  mRNA product Design2 comprising derived and/or modified sequence from Lassa virus__AIT17720__Z (opt1)
ggggcgcugccuacggagguggcagccaucuccuucucggcaucaagcuuaccaugggcaaccgccaggccaagcccaccaagguggacgagcaccagcgggcccaccuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgacccgccucaaggccgccgcccagcccagcgcccccuccacggaggagacccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5855 - RNA, 682 nt, Artificial Sequence
  mRNA product Design2 comprising derived and/or modified sequence from Lassa virus__AIT17730__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcgccccugacggaggccauccagaacaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5856 - RNA, 682 nt, Artificial Sequence
  mRNA product Design2 comprising derived and/or modified sequence from Lassa virus__AIT17734__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5857 - RNA, 682 nt, Artificial Sequence
  mRNA product Design2 comprising derived and/or modified sequence from Lassa virus__AIT17738__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcugccguccgcccccagcaccgaggucacccagaacaccacgcccccgccccacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5858 - RNA, 682 nt, Artificial Sequence
  mRNA product Design2 comprising derived and/or modified sequence from Lassa virus__AIT17750__Z (opt1)
ggggcgcugccuacggagguggcagccaucuccuucucggcaucaagcuuaccaugggcaaccgccaggccaagagcgccaaggugaacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacccagccguccgcccccagcacggaggcgacccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5859 - RNA, 682 nt, Artificial Sequence
  mRNA product Design2 comprising derived and/or modified sequence from Lassa virus__AIT17754__Z (opt1)
ggggcgcugccuacggagguggcagccaucuccuucucggcaucaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccuccgcccagccgagcgcccccuccacggaggccgcgcagaacaccgccccgccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5860 - RNA, 682 nt, Artificial Sequence
  mRNA product Design2 comprising derived and/or modified sequence from Lassa virus__AIT17760__Z (opt1)
ggggcgcugccuacggagguggcagccaucuccuucucggcaucaagcuuaccaugggcaaccgccaggccaagagcacccggaccgacgagcaccagcgcgcccaccuggugcccgacgcgucccaccucgggccccaguucugcaagagcugcugguucgagaacaagggccuggucgagugcaacaaccacuaccugugccucaacugccugucccugcuccugagcguguccagccggugccccaucugcaagaugccccugcccacgaagcucaaggccgccgcccagccguccgcccccagcaccgaggcggggcagaacaccgccccgccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5861 - RNA, 682 nt, Artificial Sequence
  mRNA product Design2 comprising derived and/or modified sequence from Lassa virus__AIT17768__Z (opt1)
ggggcgcugccuacggagguggcagccaucuccuucucggcaucaagcuuaccaugggcaaccgccaggccaagagcgccaccguggacgagugccagcgggcgcaccugguccccgacgccuccuaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccgccgcccagccguccgcgcccagcacgcgggccacccagaacaccaccccgccgcccuacacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5862 - RNA, 682 nt, Artificial Sequence
  mRNA product Design2 comprising derived and/or modified sequence from Lassa virus__AIT17776__Z (opt1)
ggggcgcugccuacggagguggcagccaucuccuucucggcaucaagcuuaccaugggcaacaagcaggccaagagcaccaagguggacgagcaccagcgcgcccaccugguccccgacgcgucccaccucgggccccaguucugcaagagcugcugguucgagaacaagggccugguggagugcaacaaccacuaccugugccucaacugccugucccugcuccugagcguguccagccggugccccaucugcaagaugccccugcccacccgccucaaggccgccgcccagccguccgcccccagcacggaggcgacccagaacgccgccccgccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5863 - RNA, 682 nt, Artificial Sequence
  mRNA product Design2 comprising derived and/or modified sequence from Lassa virus__AIT17780__Z (opt1)
ggggcgcugccuacggagguggcagccaucuccuucucggcaucaagcuuaccaugggcaaccgccagaccaagagcaccaagguggacgagcaccagcgggccuaccugguccccgacgccucccuccuggggccccaguucugcaagagcugcugguucgagaacaagggccugguggagugcaacaaccacuaccucugccugaacugccugucccuccugcugagcguguccagccgcugccccaucugcaagaugccccuccccacgcggcugaaggcggccgcccagcccuccgccccgcccaccgaggccauccagaacaccacgccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5864 - RNA, 682 nt, Artificial Sequence
  mRNA product Design2 comprising derived and/or modified sequence from Lassa virus__AIT17784__Z (opt1)
ggggcgcugccuacggagguggcagccaucuccuucucggcaucaagcuuaccaugggcaaccgccagaccaagcccaccaagguggacgagcaccagcgggcccaccuggucccggacgccagccaccucgggccccaguucugcaaguccugcugguucgagaacaagggccugguggagugcaacaaccacuaccugugccucaacugccugagccugcuccuguccgugagcucccgcugccccaucugcaagaugccccugccgacgaagcucaaggcgaccgcccagcccagcgcccccuccaccgaggccgcccagaacaccgcgcccccgcccuacgcccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5865 - RNA, 682 nt, Artificial Sequence
  mRNA product Design2 comprising derived and/or modified sequence from Lassa virus__AIT17788__Z (opt1)
ggggcgcugccuacggagguggcagccaucuccuucucggcaucaagcuuaccaugggcaaccgccaggucaagagcaccaagguggacgagcaccagcgggcccaccuggugcccgacgccucccaccucgggccccaguucugcaagagcugcugguucgagaaccgcggccugguggagugcaacaaccacuaccugugccucaacugccugucccugcuccugagcgucuccagccggugccccaucugcaagaugccccugcccaccaagcucaaggcggccacgcagccguccgccccgcccaccgaggccacccagaagaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5866 - RNA, 682 nt, Artificial Sequence
  mRNA product Design2 comprising derived and/or modified sequence from Lassa virus__AIT17792__Z (opt1)
ggggcgcugccuacggagguggcagccaucuccuucucggcaucaagcuuaccaugggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccgggcgcugccccaucugcaagaugccccugcccaccaagcucaaggccacggcccagccgagcgcccccuccaccgaggccacccagaacaccacgcccccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5867 - RNA, 682 nt, Artificial Sequence
  mRNA product Design2 comprising derived and/or modified sequence from Lassa virus__AIT17796__Z (opt1)
ggggcgcugccuacggagguggcagccaucuccuucucggcaucaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccgcccagccguccgcccccagcacggaggcgauccagaacaccaccccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5868 - RNA, 682 nt, Artificial Sequence
  mRNA product Design2 comprising derived and/or modified sequence from Lassa virus__AIT17800__Z (opt1)
ggggcgcugccuacggagguggcagccaucuccuucucggcaucaagcuuaccaugggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccgcugcccacgaagcuccgccccuccgccacccccaccgccccgcccaccgaggcggccgacagcauccggcccccgcccuaccaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5869 - RNA, 682 nt, Artificial Sequence
  mRNA product Design2 comprising derived and/or modified sequence from Lassa virus__AIT17804__Z (opt1)
ggggcgcugccuacggagguggcagccaucuccuucucggcaucaagcuuaccaugggcaacaagcaggccaaggccagcgaggagaagaacagcccccgcgccucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcaccacccccaccgcgcccccgacgggggccgccgacuccauccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5870 - RNA, 682 nt, Artificial Sequence
  mRNA product Design2 comprising derived and/or modified sequence from Lassa virus__AIT17808__Z (opt1)
ggggcgcugccuacggagguggcagccaucuccuucucggcaucaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgcgccuccggcccagcgccgcccccaccgccccgcccaccggggcggccgacuccacccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5871 - RNA, 685 nt, Artificial Sequence
  mRNA product Design2 comprising derived and/or modified sequence from Lassa virus__AIT17834__Z (opt1)
ggggcgcugccuacggagguggcagccaucuccuucucggcaucaagcuuaccaugggcaacaagcagacccgcagcccgcccaagcccgagcacccccggcccacccugcuccccgacgccucccaccuggggccccaguucugcaagagcugcugguucgagaacaagggccugguggagugcaacaaccacuaccucugccugaacugccugacgcuccugcuguccgucagcgaccgcugccccaucugcaagaugccccuccccaccaagcuggccgugcggacccagcccuccgcgccgccccugaaccaggggaacacccagagcagcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5872 - RNA, 682 nt, Artificial Sequence
  mRNA product Design2 comprising derived and/or modified sequence from Lassa virus__AIT17838__Z (opt1)
ggggcgcugccuacggagguggcagccaucuccuucucggcaucaagcuuaccaugggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccgcugccccaucugcaagaugccgcugcccacgaagcucaagcccagcgccgcccccaccgccccgcccaccggggccgcggacuccauccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5873 - RNA, 682 nt, Artificial Sequence
  mRNA product Design2 comprising derived and/or modified sequence from Lassa virus__AIT17842__Z (opt1)
ggggcgcugccuacggagguggcagccaucuccuucucggcaucaagcuuaccaugggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccggugccccaucugcaagaugccgcugcccacgaagcuccgccccagcgccgcccccaccgccccgcccaccgggguggccgacuccauccggcccccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5874 - RNA, 682 nt, Artificial Sequence
  mRNA product Design2 comprising derived and/or modified sequence from Lassa virus__ANH09743__Z (opt1)
ggggcgcugccuacggagguggcagccaucuccuucucggcaucaagcuuaccaugggcaacaagcaggccaaggccagcgagguggaggacgggccccgcgccucccugauccccgacgccacccaccucggcccccaguucugcaagagcugcugguucgagaacaagucccuggucgagugcaacaaccacuaccugugccucaacugccugacccugcuccugagcguguccaaccggugccccaucugcaagaugccccugccgacgcgccucaagcccagcgugguccccaccgcgcccccgacccgggccggggacggcacccgcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5875 - RNA, 682 nt, Artificial Sequence
  mRNA product Design2 comprising derived and/or modified sequence from Lassa virus__ANH09745__Z (opt1)
ggggcgcugccuacggagguggcagccaucuccuucucggcaucaagcuuaccaugggcaacaagcagaccaaggcccccgagguggaggacgggccccgcgccagccugauccccgacgcgacccaccucggcccccaguucugcaaguccugcugguucgagaacaaggggcuggucgagugcaacaaccacuaccugugccucaacugccugacgcugcuccugagcguguccagccggugccccaucugcaagaugccgcugcccacccgccucaagcccuccaucgugcccaccgccccgcccgcccggaccggcgagaacacgcgcccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5876 - RNA, 682 nt, Artificial Sequence
  mRNA product Design2 comprising derived and/or modified sequence from Lassa virus__ANH09749__Z (opt1)
ggggcgcugccuacggagguggcagccaucuccuucucggcaucaagcuuaccaugggcaacaagcaggccaaggcccccgagguggaggacgggccccgcgcgagccugauccccgacgccacccaccucggcccccaguucugcaaguccugcugguucgagaaccgggggcuggucgagugcaacaaccacuaccugugccucaacugccugacccugcuccugagcguguccaaccgcugccccaucugcaagaugccgcugcccacgcggcucaagcccagcgugguccccaccgccccgcccaccggcgccgggggcgacacccgcccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5877 - RNA, 682 nt, Artificial Sequence
  mRNA product Design2 comprising derived and/or modified sequence from Lassa virus__ANH09751__Z (opt1)
ggggcgcugccuacggagguggcagccaucuccuucucggcaucaagcuuaccaugggcaacaagcaggccaaggcccccaaggcggaggacgggccgcgcgccagccugauccccgacgccacccaccucggcccccaguucugcaaguccugcugguucgagaacaaggggcugguggagugcaacaaccacuaccugugccucaacugccugacccugcuccugagcgucuccaaccggugccccaucugcaagaugccgcugcccacgcgccucaagcccagcguggugcccaccgccccgcccaccggcgccgggggcgacacccggcccccgccccacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5878 - RNA, 682 nt, Artificial Sequence
  mRNA product Design2 comprising derived and/or modified sequence from Lassa virus__ANH09753__Z (opt1)
ggggcgcugccuacggagguggcagccaucuccuucucggcaucaagcuuaccaugggcaacaagcaggccaaggccagcgaggcggaggacgggccccgcgccucccugauccccgacgccacccaccucggcccccaguucugcaagagcugcugguucgagaacaaggggcugguggagugcaacaaccacuaccugugccucaacugccugacccugcuccuguccgucagcucccggugccccaucugcaagaugccccugccgacgcgccuccggcccagcguggugcccaccgcccccuccgccggcgcgggggacggcacccgcccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5879 - RNA, 682 nt, Artificial Sequence
  mRNA product Design2 comprising derived and/or modified sequence from Lassa virus__ANH09755__Z (opt1)
ggggcgcugccuacggagguggcagccaucuccuucucggcaucaagcuuaccaugggcaacaagcagaccaagaccaucaagaagacggacagcccccgcgccucccugauccccgacgccagccacauggggccccaguucugcaaguccugcugguucgagaaccggggccucguggagugcaacaaccacuaccugugccugaacugccucagccugcugcucuccgucagcaaccgcugccccaucugcaagaugccccugccgaccaagcugcgggcgucccccagccccaccgcccccuccauccgcgaggccaacaucaccaacccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5880 - RNA, 682 nt, Artificial Sequence
  mRNA product Design2 comprising derived and/or modified sequence from Lassa virus__ANH09759__Z (opt1)
ggggcgcugccuacggagguggcagccaucuccuucucggcaucaagcuuaccaugggcaacaagcagaccaagaccacgaagaagaccgacagcccccgcgccucccugauccccgacgccagccacauggggccccaguucugcaaguccugcugguucgagaaccggggccucguggagugcaacaaccacuaccugugccugaacugccucagccugcugcucuccgucagcaaccgcugccccaucugcaagaugccccugccgaccaagcugcgggcgucccccagccccaccgcccccuccauccgcgaggccaacaucacgaacccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5881 - RNA, 682 nt, Artificial Sequence
  mRNA product Design2 comprising derived and/or modified sequence from Lassa virus__ANH09761__Z (opt1)
ggggcgcugccuacggagguggcagccaucuccuucucggcaucaagcuuaccaugggcaacaaggggaccaagcccacccagaacagcgagcccucccgcgccaaccuggugcccgacgccagcuaccucggcccccaguucugcaaguccugcugguucgagaacaaggggcuggucgagugcaacaaccacuaccugugccucaacugccugacgaugcugcucagcguguccaaccggugccccaucugcaagaugccgcugcccaccaagaucaaggccagcggcucccccagcgcgcccccgaccgaggccaacuccgccgugagcccgccgcccuacacccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5882 - RNA, 682 nt, Artificial Sequence
  mRNA product Design2 comprising derived and/or modified sequence from Lassa virus__AMR44579__Z (opt1)
ggggcgcugccuacggagguggcagccaucuccuucucggcaucaagcuuaccaugggcgcccgccagaccaagcagccccagaucgaggggagcccccgggccucccuggugcccgacgcgagccaccucggcccccaguucugcaaguccugcugguucgagaacaaggggcuggucgagugcaacaaccacuaccugugccucaacugccugagccugcuccuguccgugagcaaccgcugccccaucugcaagaugccgcugcccaccaagcuccggguguccagcgcccccuccgcgcccccggccgccacggcccagcccggcaccccgccgcccuacagccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5883 - RNA, 682 nt, Artificial Sequence
  mRNA product Design2 comprising derived and/or modified sequence from Lassa virus__AMZ00378__Z (opt1)
ggggcgcugccuacggagguggcagccaucuccuucucggcaucaagcuuaccaugggcaaccgccagaccaaggccaccgaggccaaggacagcccccgggcgucccugauccccgacgccacgcaccucgggccccaguucugcaagagcugcugguucgagaacaagggccugguggagugcaacaaccacuaccugugccucaacugccugacccugcuccuguccgucagcucccgcugccccaucugcaagaugccccugccgacccggcucaagagcuccaccaaccccacggcccccagcgccaagaccgaguccagcaucaacccgccgcccuacucccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5884 - RNA, 1655 nt, Artificial Sequence
  mRNA product Design3 comprising derived and/or modified sequence from Lassa virus__AAF86703__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugaucuccuuccuccugcugugcggccgcagcugcuccgugacguacaaggggguguacgagcuccagacccuggagcugaacauggccaaccucaacaugaccaugccgcugagcugcaccaagaacaacucccaccacuacaucauggucggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcgugcaguacaaccucucccacagcuucgcgguggacgccgccaaccacugcgggaccaucgccaacggcguccugcagaccuucaugcggauggcguggggcggguccuacaucgcccuggacagcggcaaggggaacugggacugcaucaugaccuccuaccaguaccucaucauccagaacacgaccugggaggaccacugccaguucagccgccccucccccaucggcuaccuggggcugcucagccagcggacccgcgacaucuacaucagccggcgccugcugggcaccuucacguggacccucuccgacagcgagggcaacgaggcccccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccaucaagcggcucaagacggaggcccagauguccauccagcugaucaacaaggccgugaacgcccugaucaacgaccagcucaucaugaagaaccaccuccgcgacaucaugggcauccccuacugcaacuacagccgguacugguaccugaaccacaccgucaccgggaagaccucccugccccgcugcuggcuggugagcaacggcuccuaccugaacgagacgcacuucagcgacgacaucgagcagcaggcggacaacaugaucaccgagaugcuccagaaggaguacauggaccggcagggcaagaccccgcuggggcugguggaccucuucgucuucuccaccagcuucuaccugaucuccaucuuccugcaccuggugaagaucccgacgcaccgccacaucgugggcaagcccugccccaagccccaccggcucaaccacauggggaucugcagcugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5885 - RNA, 1658 nt, Artificial Sequence
  mRNA product Design3 comprising derived and/or modified sequence from Lassa virus__AAG41802__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcugaucacguuccuccugcugugcggccgcuccugcagcuccaaccucuacaaggggguguacgagcugcagagccuggaccucaacauggagacccugaacaugaccaugccgcuguccugcaccaagaacaacagccaccacuacauccgggucggcaacgacacgggccucgagcugacccugaccaacaccuccauccucaaccacaaguucugcaaccugagcgacgcccacaagaaggaccuguacgaccacgcccucauguccaucaucagcacguuccaccuguccauccccaacuucaaccaguacgaggccaugagcugcgacuucaacgggggcaagaucuccgugcaguacaaccugagccacuccuacgccaucgacgcggccaaccacugcgggaccguggccaacggcauccuccagaccuucaugcgcauggccuggggcgggagcuacaucgcgcuggacuccggccgggggaacugggacugcaucaugaccagcuaccaguaccugaucauccagaacacgaccugggagaaccacugccaguucucccgccccagccccaucggcuaccucgggcugcugagccagcggacccgcgacaucuacaucucccggcgccuccugggcaccuucacguggacccugagcgacuccgagggcaacgccacccccgggggcuacugccucacccgguggaugcugaucgaggccgagcugaagugcuucgggaacacggccgucgccaagugcaacgagaagcacgacgaggaguucugcgacaugcuccgccuguucgacuucaacaagcaggcgaucagccggcugaaguccgaggcccagaugagcauccagcucaucaacaaggccgugaacgcccugaucaacgaccagcugaucaugaagaaccaccuccgcgacaucaugggcauccccuacugcaacuacuccaaguacugguaccugaaccacaccaucaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcagggcaagaccccgcucgggcuggucgaccuguucguguucagcaccuccuucuaccugaucagcaucuuccuccgccuggugaagaucccgacgcaccggcacaucgucggcaagcccugccccaagccccaccgccugaaccacauggggaucugcuccugcggccucuacaagcagccgggggugcccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5886 - RNA, 1655 nt, Artificial Sequence
  mRNA product Design3 comprising derived and/or modified sequence from Lassa virus__AAL13212__GPC (opt1)
gggagaaagcuuaccaugggccagaucgugaccuucuuccaggaggucccccacgugaucgaggagaucaugaacaucgugcugaucacccucagccugcuggccauccucaagggggucuacaaccuggccacgugcggccugaucgggcucaucaccuuccuguuccugugcggccgcuccugcagcaugaccuacaagggguccuaccagcucgagacccuggagcugaacauggagacgcucaacaugaccaugccgcugagcugcaccaagaacaccucccaccacuacauccgggugggcaacgagacgggccuggagcucacccugaccaacaccagcaucaucaaccacaaguucugcaaccuguccgacgcgcacaagaagaaccucuacgaccacagccugauguccaucaucagcacguuccaccuguccauccccaacuucaaccaguacgaggccaugagcugcgacuucaacgggggcaagaucuccauccaguacaaccucagccacaccuacgccggggacgccgccaagcacugcggcacccuggcgaacgggauccugcagaccuucaugcgcauggccuggggcggcuccuacaucgcccucgacagcgggcggggcaacugggacugcaucaugacguccuaccaguaccugaucauccagaacaccaccugggaggaccacugccaguucagccgccccucccccaucggguaccugggccuccugagccagcggacccgcgagaucuacaucagccggcgccugcucggcacguucaccuggacccuguccgacagcgaggggaacgagaacccgggcggguacugccugacccgguggaugcucaucgaggccgagcugaagugcuucggcaacacggcgguggccaagugcaacgagaagcacgacgaggaguucugcgacaugcugcgccucuucgacuucaacaagcaggccauccagcggcugaaggccgaggcccagauguccauccagcugaucaacaaggcggucaacgcccucaucaacgaccagcugaucaugaagaaccaccuccgcgacaucauggggauccccuacugcaacuacagcaaguacugguaccugaaccacaccaccaccggccggacgucccugccccgcugcuggcuggugagcaacggcuccuaccucaacgagacccgguucagcgacgacaucgagcagcaggccgacaacaugaucaccgagaugcugcagaaggaguacaucgaccgccaggggaagacgccccugggccucguggaccuguucgucuucuccaccagcuucuaccugaucuccaucuuccugcaccucaucaagaucccgacccaccggcacaucgucgggggccccugccccaagccccaccgccugaaccacaaggggaucugcagcugcggccuguacaagcggccgggcguguccgugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5887 - RNA, 1658 nt, Artificial Sequence
  mRNA product Design3 comprising derived and/or modified sequence from Lassa virus__AAO59512__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucgccuuccuccugcugugcggccgcuccugcacgagcucccucuacaaggggguguacgagcugcagacccuggagcucaacauggagacccugaacaugaccaugccgcugagcugcacgaagaacaacucccaccacuacauccgggugggcaacgagaccggccucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgguggacgccgccaagcacugcgggaccguggccaacggcguccugcagaccuucaugcgcauggcguggggcggguccuacaucgcccucgacagcggccacgggcggugggacugcaucaugacguccuaccaguaccugaucauccagaacaccaccugggaggaccacugccaguucagccgccccucccccaucggcuaccuggggcuccugagccagcggacccgcgacaucuacaucagccggcgccugcucggcacguucaccuggacccuguccgacagcgagggcaaggacacccccgggggcuacugccugacgcgguggaugcucaucgaggccgagcugaagugcuucgggaacaccgccguggccaagugcaacgagaagcacgacgaggaguucugcgacaugcugcgccucuucgacuucaacaagcaggcgauccagcggcugaagaccgaggcccagauguccauccagcugaucaacaaggccgugaacgcccucaucaacgaccagcugaucaugaagaaccaccuccgcgacaucaugggcauccccuacugcaacuacagccgguacugguaccugaaccacaccacgaccgggaagaccucccugcccaagugcuggcuggucagcaacggcuccuaccucaacgagacccgcuucagcgacgacaucgagcagcaggccgacaacaugaucacggagaugcugcagaaggaguacauggagcggcagggcaagaccccgcuggggcucguggaccuguucguguucuccaccagcuucuaccugaucuccaucuuccugcaccucgucaagaucccgacccaccgccacaucgugggcaagagcugccccaagccccaccggcugaaccacauggggaucugcuccugcggccuguacaagcagcccggggugccggucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5888 - RNA, 1658 nt, Artificial Sequence
  mRNA product Design3 comprising derived and/or modified sequence from Lassa virus__AAT49000__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccucuuccugugcggccgcuccugcagcaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacacccugaugagcaucaucuccaccuuccaccugagcauccccaacuucaaccaguacgaggccauguccugcgacuucaacgggggcaagaucagcguccaguacaaccucucccacagcuacgccguggacgccgcgaaccacugcgggacgguggccaacggcguccugcagaccuucaugcggauggccuggggcggguccuacaucgcccuggacagcggccgcgggaacugggacugcaucaugaccuccuaccaguaccucgugauccagaacaccacgugggaggaccacugccaguucagccggcccucccccaucggcuaccuggggcugcucagccagcgcacccgggacaucuacaucagccgccggcugcugggcaccuucaccuggacgcucuccgacagcgagggcaaggacacccccgggggcuacugccugacccgcuggaugcugaucgaggcggagcucaagugcuucgggaacaccgccguggccaagugcaacgagaagcacgacgaggaguucugcgacaugcugcggcuguucgacuucaacaagcaggccauccagcgccucaaggccgaggcgcagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugcccaagugcuggcuggugagcaacggcuccuaccugaacgagacccacuucagcgacgacaucgagcagcaggccgacaaccucaucacggagaugcugcagaaggaguacauggagcgccagggcaagaccccgcuggggcucgucgaccuguucguguucuccaccagcuucuaccugaucuccaucuuccugcaccucgugaagaucccgacccaccggcacaucgucggcaagcccugccccaagccccaccgccugaaccacauggggaucugcagcugcggcguguacaagcagccgggggugcccguccgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5889 - RNA, 1658 nt, Artificial Sequence
  mRNA product Design3 comprising derived and/or modified sequence from Lassa virus__AAT49004__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5890 - RNA, 1658 nt, Artificial Sequence
  mRNA product Design3 comprising derived and/or modified sequence from Lassa virus__AAT49008__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccucuuccugugcggccgcuccugcagcaccacccuguacaaggggguguacgagcuccagacccuggagcugaacauggagacgcucaacaugaccaugccgcuguccugcaccaagaacaacagccaccacuacaucauggugggcaacgagaccggccuggagcucacgcugaccaacaccuccaucaucaaccacaaguucugcaaccugagcgacgcccacaagaagaaccucuacgaccacacccugauguccaucaucagcacguuccaccuguccauccccaacuucaaccaguacgaggccaugagcugcgacuucaacgggggcaagaucuccguccaguacaaccucagccacuccuacgccguggacgccgcgaaccacugcgggaccguggccaacggcguccugcagaccuucaugcggauggccuggggcgggagcuacaucgcccuggacuccggccgcgggaacugggacugcaucaugaccagcuaccaguaccucaucauccagaacacgaccugggaggaccacugccaguucucccggcccagccccaucggcuaccuggggcugcucucccagcgcacccgggacaucuacaucagccgccggcugcugggcaccuucacguggacccucagcgacuccgagggcaaggacacccccgggggcuacugccugacccgcuggaugcugaucgaggcggagcucaagugcuucgggaacacggccguggccaagugcaacgagaagcacgacgaggaguucugcgacaugcugcggcuguucgacuucaacaagcaggccauccagcgccucaaggccgaggcgcagaugagcauccagcugaucaacaaggccgugaacgcccugaucaacgaccagcucaucaugaagaaccaccuccgggacaucaugggcauccccuacugcaacuacucccgcuacugguaccugaaccacaccgucaccgggaagaccagccugcccaagugcuggcugguguccaacggcagcuaccugaacgagacgcacuucuccgacgacaucgagcagcaggccgacaaccucaucaccgagaugcugcagaaggaguacauggagcggcagggcaagaccccgcuggggcucguggaccuguucgucuucagcaccuccuucuaccugaucagcaucuuccugcaccucgugaagaucccgacgcaccgccacaucgugggcaagcccugccccaagccccaccggcugaaccacauggggaucugcuccugcggcgucuacaagcagccgggggugcccgugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5891 - RNA, 1655 nt, Artificial Sequence
  mRNA product Design3 comprising derived and/or modified sequence from Lassa virus__AAT49010__GPC (opt1)
gggagaaagcuuaccaugggccagaucgugaccuucuuccaggaggucccccacgugaucgaggaggugaugaacaucguccugaucgcccucagcgugcuggccauccugaaggggcucuacaacuucgcgaccugcggccugaucgggcuggugacguuccuccugcuguccggccgcagcugcuccaugaucuacaagggggucuacgagcuccagacccuggagcugaacauggagacccucaacaugaccaugccgcugagcugcacgaagaacaccucccaccacuacauccgggugggcaacgacaccggccuggagcucacccugacgaacgagacccugcuccaccacaaguucugcaaccugagcgacgcccacaagcgcaaccuguacgaccacgcccucauguccaucaucagcaccuuccaccuguccauccccaacuucaaccaguacgaggccaugagcugcgacuucaacgggggcaagaucaccgugcaguacaaccugucccacagcuacgccgucgacgcggccaagcacugcgggacgguggccaacggcgugcuccagaccuucaugcggauggccuggggcggguccuacaucgcgcuggacagccgccacggcaacugggacugcaucaugaccuccuaccaguaccugaucauccagaacaccacgugggaggaccacugccaguucagccggcccucccccaucggguaccucggccugcugagccagcgcacccgggacaucuacaucucccgccggcuccuggggaccuucaccuggacgcugagcgacagcgagggcaacgagaccccgggcggguacugccucacccgcuggaugcugaucgaggccgagcugaagugcuucggcaacaccgccgucgccaagugcaacgagaagcacgacgaggaguucugcgacaugcuccggcuguucgacuucaacaagcaggccauccgccggcugaagacggaggcgcagauguccauccagcucaucaacaaggccgugaacgcccugaucaacgaccagcugaucaugaagaaccaccuccgcgacaucauggggauccccuacugcaacuacagcaaguacugguaccugaaccacaccuccaccggcaagaccagccugccccggugcuggcucguguccaacgggagcuaccugaacgagacgcacuucuccgacgacaucgagcagcaggccgacaacaugaucaccgagaugcugcagaaggaguaccucgaccgccagggcaagacgccccugggccuggucgaccuguucguguucagcaccuccuucuaccucaucagcaucuuccugcaccugaucaagaucccgacccaccggcacaucguggggaagcccugccccaagccccaccgccucaaccacaugggcaucugcuccugcgggcuguacaagcagccgggcguccccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5892 - RNA, 1655 nt, Artificial Sequence
  mRNA product Design3 comprising derived and/or modified sequence from Lassa virus__AAT49014__GPC (opt1)
gggagaaagcuuaccaugggccagaucaucaccuucuuccaggaggugccccacgucaucgaggaggugaugaacaucgugcugaucgcccucagccugcuggccauccucaaggggcuguacaacaucgcgaccugcggcaucaucgggcuggucgccuuccucuuccugugcggcaaguccugcagccugacgcucaagggcggguacgagcugcagacccuggagcucaacauggagacccugaacaugaccaugccgcuguccugcacgaagaacagcucccaccacuacauccgcgugggcaacgagaccgggcucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacggcgggaagaucagcgugcaguacaaccugucccacagcuacgcgggcgacgccgccgagcacugcgggaccgucgccaacggcgugcugcagaccuucaugcggauggcguggggcgggcgcuacaucgcccucgacuccggcaaggggaacugggacugcaucaugacgagcuaccaguaccugaucauccagaacaccaccugggaggaccacugccaguucucccggcccagccccaucggcuaccugggccuccugucccagcgcacccgggacaucuacaucagccgccggcugcucgggacguucaccuggacccugagcgacuccgagggcaacgagacccccgggggcuacugccugacgcgcuggaugcucaucgaggccgagcugaagugcuucgggaacaccgccguggccaagugcaacgagaagcacgacgaggaguucugcgacaugcugcggcuguucgacuucaacaagcaggcgauccgccggcugaaggccgaggcccagaugagcauccagcugaucaacaaggccgucaacgcccucaucaacgaccagcugaucaugaagaaccaccuccgcgacaucaugggcauccccuacugcaacuacuccaaguacugguaccucaaccacaccagcuccggccggaccagccugcccaagugcuggcugaucuccaacgggagcuaccucaacgagacgcaguucuccgacgacaucgagcagcaggcggaccacaugaucaccgagaugcugcagaaggaguacaucgagcgccagggcaagaccccgcuggggcucguggacaucuucaucuucagcaccuccuucuaccugaucagcaucuuccugcaccugaucaagaucccgacgcaccggcacaucgugggcaagcccugccccaagccccaccgccucaaccacaugggggucugcuccugcggccuguacaagcacccgggcgugcccaccaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5893 - RNA, 1658 nt, Artificial Sequence
  mRNA product Design3 comprising derived and/or modified sequence from Lassa virus__AAV54104__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgagggggaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5894 - RNA, 1658 nt, Artificial Sequence
  mRNA product Design3 comprising derived and/or modified sequence from Lassa virus__ADI39451__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacgucgcgaccugcggccugaucgggcugaucgccuuccuccugcugugcggccgcuccugcacgaccacccucuacaaggggguguacgagcugcaggcccuggagcucaacauggagacccugaacaugacgaugccgcugagcugcaccaagaacaacucccaccacuacaucauggugggcaacgagaccggccucgagcugacccugacgaacaccagcaucaucaaccacaaguucugcaaccucuccgacgcccacaagaagaaccuguacgaccacgcccugaugagcaucaucuccaccuuccaccucagcauccccaacuucaaccaguacgaggcgauguccugcgacuucaacgggggcaagaucagcguccaguacaaccugucccacaccuacgccguggacgccgccaaccacugcgggacgguggcgaacggcguccugcagaccuucaugcggauggccuggggcgggagcuacaucgcccucgacuccggccgcgggagcugggacugcaucaugaccuccuaccaguaccugaucauccagaacaccacgugggaggaccacugccaguucagccggcccucccccaucggcuaccuggggcuccugagccagcgcacccgggacaucuacaucucccgccggcugcucggcaccuucaccuggacgcugagcgacagcgagggcaaggacacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgccugaaggccgaggcccagauguccauccagcugaucaacaaggccgugaacgcgcucaucaacgaccagcugaucaugaagaaccaccuccgggacaucaugggcauccccuacugcaacuacagcaaguacugguaccucaaccacacgaucaccgggcgcaccucccugcccaagugcuggcuggucagcaacggcuccuaccucaacgagacccacuucagcgacgacaucgagcagcaggccgacaacaugaucacggagaugcugcagaaggaguacaucgagcggcagggcaagaccccgcuggggcucguggaccuguucguguucuccaccagcuucuaccugaucuccaucuuccugcaccucaucaagaucccgacccaccgccacaucgucaacaagcccugccccaagccccaccggcugaaccacaugggcgugugcagcugcgggcuguacaagcagccgggcgugcccguccgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5895 - RNA, 1655 nt, Artificial Sequence
  mRNA product Design3 comprising derived and/or modified sequence from Lassa virus__ADU56610__GPC (opt1)
gggagaaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugaucuccuuccuccugcugugcggccgcagcugcuccacgaccuacaaggggguguacgagcuccagacccuggagcuggacauggccaaccucaacaugaccaugccgcugagcugcacgaagaacuccagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaaggggaacugggacugcaucaugacguccuaccaguaccucaucauccagaacaccaccugggaggaccacugccaguucagccgccccucccccaucggcuaccuggggcugcucagccagcggacccgcgacaucuacaucagccggcgccugcugggcacguucaccuggacccucuccgacagcgagggcaacgaggcccccgggggcuacugccugacccgguggaugcugaucgaggccgagcucaagugcuucgggaacacggcgaucgccaagugcaacgagaagcacgacgaggaguucugcgacaugcugcgccuguucgacuucaacaagcaggccaucaagcggcucaaggccgaggcccagauguccauccagcugaucaacaaggcggugaacgcccugaucaacgaccagcucaucaugaagaaccaccuccgcgacaucaugggcauccccuacugcaacuacagcaaguacugguaccugaaccacaccgugaccgggaagaccucccugccccggugcuggcugaucagcaacggcuccuaccugaacgagacgcacuucagcgacgacaucgagcagcaggccgacaacaugaucaccgagcuccugcagaaggaguacauggaccgccagggcaagaccccgcuggggcucgucgaccuguucguguucuccaccagcuucuaccugaucuccaucuuccugcaccucgugaagaucccgacgcaccggcacaucgucggccgccccugccccaagccccaccggcugaaccacauggggaucugcagcugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5896 - RNA, 1655 nt, Artificial Sequence
  mRNA product Design3 comprising derived and/or modified sequence from Lassa virus__ADU56618__GPC (opt1)
gggagaaagcuuaccaugggccagaucgugaccuucuuccaggaggucccccacgugaucgaggaggugaugaacaucguccugaucgcccucagcauccuggccauccugaaggggcucuacaacaucgcgaccugcggccugaucgggcuggugacguuccuccugcuguccggccgcagcugcuccaugaccuacaaggggguguacgagcuccagacccuggagcugaacaugaacacccucaacaugacgaugccgcugagcugcaccaagaacaacucccaccacuacaucauggucggcaacgagaccggccuggagcucacccugacgaacaccagccugcuccaccacaaguucugcaaccuguccgacgcccacaagaagaaccuguacgaccacacccucaugagcaucaucuccaccuuccaccugagcauccccaacuucaaccaguacgaggccauguccugcgacuucaacgggggcaagaucacggugcaguacaaccugagccacuccuacgccaucgacgccgcgaaccacugcgggaccguggccaacggcguccuccagaccuucaugcggauggccuggggcgggagcuacaucgcccuggacuccggccgcgggaagugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgagacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccgccggcugaaggccgaggcgcagaugagcauccagcucaucaacaaggccgugaacgcccugaucaacgaccagcugaucaugaagaaccaccuccgcgacaucaugggcauccccuacugcaacuacuccaaguacugguaccugaaccacaccagcaccgggcggaccucccugccccgcugcuggcucgucagcaacggcuccuaccugaacgagacgcacuucagcgacgacaucgagcagcaggccgacaacaugaucaccgagaugcugcagaaggaguaccucgaccggcagggcaagaccccgcuggggcugguggaccuguucguguucuccaccagcuucuaccucaucuccaucuuccugcaccuggucaagaucccgacgcaccgccacaucgugggcaagcccugccccaagccccaccggcucaaccacauggggaucugcagcugcggccuguacaagcagccgggggugcccguccgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5897 - RNA, 1655 nt, Artificial Sequence
  mRNA product Design3 comprising derived and/or modified sequence from Lassa virus__ADU56622__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5898 - RNA, 1655 nt, Artificial Sequence
  mRNA product Design3 comprising derived and/or modified sequence from Lassa virus__ADU56626__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcugaacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccgucacggggaagaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5899 - RNA, 1655 nt, Artificial Sequence
  mRNA product Design3 comprising derived and/or modified sequence from Lassa virus__ADU56630__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugcgcaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5900 - RNA, 1658 nt, Artificial Sequence
  mRNA product Design3 comprising derived and/or modified sequence from Lassa virus__AFY05588__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggaccuguacaucagccgccggcuccugggcaccuucaccuggacgcugagcgacuccgagggggaggacaccccgggcggguacugccucacccgcuggaugcugaucgaggccgagcugaagugcuucggcaacaccgccguggccaagugcaacgagaagcacgacgaggaguucugcgacaugcuccggcuguucgacuucaacaagcaggccauccagcgccugaaggcggaggcccagaugagcauccagcucaucaacaaggccgugaacgcccugaucaacgaccagcugaucaugaagaaccaccuccgggacaucauggggauccccuacugcaacuacuccaaguacugguaccugaaccacacgaccaccggccgcaccagccugcccaagugcuggcucgucuccaacggcagcuaccugaacgagacgcacuucuccgacgacaucgagcagcaggccgacaacaugaucaccgagaugcugcagaaggaguacauggagcggcaggggaagacgccccucggccugguggaccuguucguguucagcaccuccuucuaccugaucagcaucuuccuccaccuggucaagaucccgacccaccgccacaucguggggaaguccugccccaagccccaccggcugaaccacaugggcaucugcagcugcgggcucuacaagcagcccggcgugccggucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5901 - RNA, 1658 nt, Artificial Sequence
  mRNA product Design3 comprising derived and/or modified sequence from Lassa virus__AFY05590__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacauguacaucagccgccggcugcucggcaccuucaccuggacgcugagcgacuccgagggggaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5902 - RNA, 1658 nt, Artificial Sequence
  mRNA product Design3 comprising derived and/or modified sequence from Lassa virus__AHC95553__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguucuuccuccugugcggccgcuccugcagcuccaaccuguacaagggggucuacgagcuccagagccuggaccugaacauggagacccucaacaugaccaugccgcuguccugcaccaagaacaacagccaccacuacauccgggugggcaacgagacgggccuggagcucacccugaccaacaccucccugcucgaccacaaguucugcaaccugagcgacgcccacaagaagaaccuguacgaccacgcccucauguccaucaucagcacguuccaccuguccauccccaacuucaaccaguacgaggccaugagcugcgacuucaacgggggcaagaucaccgugcaguacaaccugucccacagcuacgccggggacgcggcccgccacugcggcaccaucgccaacgggguccuccagaccuucaugcggauggccuggggcggcuccuacaucgcgcuggacagcgggcacggcaacugggacugcaucaugacguccuaccaguaccugaucauccagaacaccaccugggaggaccacugccaguucagccgccccucccccaucggguaccucagccugcugagccagcggacccgcgacaucuacaucucccggcgccuccugggcacguucaccuggacccugagcgacuccgagggcaacgccacccccgggggcuacugccucacgcgguggaugcugaucgaggccgagcugaagugcuucgggaacaccgccguggccaagugcaacgagaagcacgacgaggaguucugcgacaugcuccgccuguucgacuucaacaagcaggcgaucagccggcugcgcuccgaggcccagaugagcauccagcucaucaacaaggccgugaacgcccugaucaacgaccagcugaucaugaagaaccaccuccgggacaucaugggcauccccuacugcaacuacuccaaguacugguaccugaaccacaccgucaccgggcgcacgagccugcccaagugcuggcucguguccaacggcagcuaccugaacgagacccacuucuccgacgacaucgagcagcaggccgacaacaugaucaccgagaugcugcagaaggaguacauggaccggcagggcaagaccccgcucgggcugguggaccuguucgucuucagcacguccuucuaccugaucagcaucuuccuccaccuggugaagaucccgacccaccgccacaucgugggcaagcccugccccaagccccaccggcugaaccgcauggggaucugcuccugcggccucuacaagcagccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5903 - RNA, 1658 nt, Artificial Sequence
  mRNA product Design3 comprising derived and/or modified sequence from Lassa virus__AHC95555__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguuccuccugcugugcggccgcuccugcagcuccaaccucuacaagggggucuacgagcugcagagccuggaccucaacauggagacccugaacaugaccaugccgcuguccugcaccaagaacaacagccaccacuacauccgggccggcaacgagacgggccucgagcugacccugaccaacaccucccucaucaaccacaaguucugcaaccugagcgacgcccacaagaagaaccuguacgaccacacgcucauguccaucaucagcaccuuccaccuguccauccccaacuucaaccaguacgaggccaugagcugcgacuucaacgggggcaagaucuccgugcaguacaaccugagccacgccuacgcgaucgacgccgccgagcacugcgggaccguggccaacggcguccuccagaccuucaugcgcauggcguggggcggguccuacaucgcccuggacagcggccgggggaacugggacugcaucaugacguccuaccaguaccugaucauccagaacaccaccugggaggaccacugccaguucagccgccccucccccaucggcuaccucgggcugcugagccagcggacccgcgacaucuacaucagccggcgccuccugggcacguucaccuggacccuguccgacagcgagggcaacgccacccccgggggcuacugccucacgcgguggaugcugaucgaggccgagcugaagugcuucgggaacaccgccguggcgaagugcaacgagaagcacgacgaggaguucugcgacaugcuccgccuguucgacuucaacaagcaggccaucucccggcucaagagcgaggcccagauguccauccagcugaucaacaaggccgugaacgcccugaucaacgaccagcugaucaugaagaaccaccuccgcgacaucaugggcauccccuacugcaacuacagcaaguacugguaccugaaccacaccaucaccgggcggacgucccugcccaagugcuggcucgucagcaacggcuccuaccugaacgagacccacuucagcgacgacaucgagcagcaggcggacaacaugaucaccgagaugcugcagaaggaguacauggagcgccagggcaagaccccgcucgggcugguggaccuguucguguucuccacgagcuucuaccugaucuccaucuuccuccaccuggucaagaucccgacccaccggcacaucgugggcaagcccugccccaagccccaccgccugaaccacauggggaucugcagcugcggccucuacaagcagccgggggugccccugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5904 - RNA, 1658 nt, Artificial Sequence
  mRNA product Design3 comprising derived and/or modified sequence from Lassa virus__AHC95557__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguucuuccuccugugcggccgcuccugcagcuccaaccuguacaagggggucuacgagcuccagagccuggaccugaacauggagacccucaacaugaccaugccgcuguccugcaccaagaacaacagccaccacuacauccgggugggcaacgagacgggccuggagcucacccugaccaacaccucccugcucaaccacaaguucugcaaccugagcgacgcccacaagcgcaaccuguacgaccacgcccucauguccaucaucagcacguuccaccuguccauccccaacuucaaccaguacgaggccaugagcugcgacuucaacgggggcaagaucaccgugcaguacaaccugucccacagcuacgccggggacaccgcgaagcacugcggcaccaucgccaacgggguccuccagacguucaugcggauggccuggggcggcuccuacaucgcccuggacagcgggcacggcaacugggacugcaucaugaccuccuaccaguaccugaucauccagaacaccaccugggaggaccacugccaguucagccgccccucccccaucggguaccucggccugcugagccagcggacgcgcgacaucuacaucagccggcgccuccugggcaccuucaccuggacccuguccgacagcgaggggaacgcgacgccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccaucucccggcugcgcagcgaggcgcagauguccauccagcucaucaacaaggccgugaacgcccugaucaacgaccagcugaucaugaagaaccaccuccgggacaucauggggauccccuacugcaacuacagcaaguacugguaccugaaccacaccgucacgggccgcaccucccugcccaagugcuggcucgugagcaacggcuccuaccugaacgagacccacuucagcgacgacaucgagcagcaggccgacaacaugaucaccgagaugcugcagaaggaguacauggaccggcaggggaagacgccccucggccugguggaccuguucgucuucuccaccagcuucuaccugaucuccaucuuccuccaccuggugaagaucccgacccaccgccacaucguggggaagcccugccccaagccccaccggcugaaccgcaugggcaucugcagcugcgggcucuacaagcagccgggcguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5905 - RNA, 1658 nt, Artificial Sequence
  mRNA product Design3 comprising derived and/or modified sequence from Lassa virus__AHC95559__GPC (opt1)
gggagaaagcuuaccaugggccagaucaucaccuucuuccaggaggugccccacgucaucgaggaggugaugaacaucgugcugaucgcccucagcauccuggccguccugaaggggcucuacaacaucgcgaccugcggccugaucgggcuggugacguuccuccugcugugcggccgcuccugcagcuccagccucuacaaggggguguacgagcugcagucccuggaccucaacauggagacccugaacaugaccaugccgcugagcugcaccaagaacaacucccaccacuacauccgggucggcaacgagacgggccucgagcugacccugaccaacaccagccucaucaaccacaaguucugcaaccuguccgacgcccacaagaagaaccuguacgaccacgcccucaugagcaucaucuccacguuccaccugagcauccccaacuucaaccaguacgaggccauguccugcgacuucaacgggggcaagaucagcgugcaguacaaccugucccacgccuacgcgaucgacgccgccagccacugcgggaccguggccaacggcguccuccagaccuucaugcgcauggcguggggcggguccuacaucgcccuggacagcggccacgggaacugggacugcaucaugaccuccuaccaguaccugaucauccagaacacgaccugggaggaccacugccaguucagccggcccagccccaucggcuaccucgggcugcugucccagcgcacccgggacaucuacaucagccgccggcuccugggcaccuucacguggacccuguccgacagcgagggcaacgccacccccgggggcuacugccucacccgcuggaugcugaucgaggccgagcugaagugcuucgggaacacggccguggcgaagugcaacgagaagcacgacgaggaguucugcgacaugcuccggcuguucgacuucaacaagcaggccaucucccgccucaagagcgaggcccagauguccauccagcugaucaacaaggccgugaacgcccugaucaacgaccagcugaucaugaagaaccaccuccgggacaucaugggcauccccuacugcaacuacagcaaguacugguaccugaaccacaccgucaccgggaagaccucccugcccaagugcuggcucgugagcaacggcuccuaccugaacgagacgcacuucagcgacgacaucgagcagcaggcggacaacaugaucaccgagaugcugcagaaggaguacauggagcgccagggcaagaccccgcucgggcugguggaccuguucgucuucuccaccagcuucuaccugaucuccaucuuccuccaccuggugaagaucccgacgcaccggcacaucgugggcaagcccugccccaagccccaccgccugaaccacauggggaucugcagcugcggccucuacaagcagccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5906 - RNA, 1658 nt, Artificial Sequence
  mRNA product Design3 comprising derived and/or modified sequence from Lassa virus__AIT17126__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcugcucacguuccugcugcucugcggccgcuccugcaccaccgggcuguacaagggcgucuacgagcugcagacccucgagcugaacauggagacgcugaacaugaccaugccgcucagcugcaccaagaacaacucccaccacuacaucauggugggcaacgagaccgggcuggagcugacgcucaccaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacggcgggaagaucagcgugcaguacaaccugucccacagcuacgccggcgacgcggccgaccacugcgggacggucgccaacggcgugcuccagaccuucaugcggauggccuggggcggguccuacaucgcgcuggacagcggccgcgggcggugggacugcaucaugaccuccuaccaguaccugaucauccagaacaccacgugggaggaccacugccaguucagccgccccucccccaucggcuaccucggccugcugagccagcggacccgcgacaucuacaucucccggcgccuccuggggaccuucaccuggacgcugagcgacagcgagggcaaggacacccccgggggcuacugccucacccgguggaugcugaucgaggccgagcugaagugcuucgggaacaccgccguggccaagugcaacgagaagcacgacgaggaguucugcgacaugcuccgccuguucgacuucaacaagcaggccauccagcggcugaaggcggaggcccagauguccauccagcucaucaacaaggccgucaacgcccugaucaacgaccagcuggugaugaagaaccaccuccgcgacaucaugggcauccccuacugcaacuacagccgguacugguaccugaaccacacgaccaccggccgcaccucccugcccaagugcuggcucgugagcaacggguccuaccugaacgagacgcacuucagcgacgacaucgagcagcaggccgacaacaugaucaccgagaugcugcagaaggaguacauggagcggcagggcaagaccccgcucgggcuggucgaccuguucguguucuccaccagcuucuaccugaucuccaucuuccuccaccuggugaagaucccgacgcaccgccacaucgucggcaagagcugccccaagccccaccggcugaaccacauggggaucugcuccugcggccucuacaagcagcccggcgugccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5907 - RNA, 1658 nt, Artificial Sequence
  mRNA product Design3 comprising derived and/or modified sequence from Lassa virus__AIT17130__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggcuucguggggcuggucacguuccugcuccugugcggccgcuccugcaccaccagccuguacaaggggguguacgagcuccagacccuggagcugaacauggagacgcucaacaugaccaugccgcuguccugcaccaagaacaacagccaccacuacauccgggugggcaacgacaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccagccacugcgggacgaucgccaacggcgugcugcagaccuucaugcgcauggccuggggcggguccuacaucgcgcuggacagcggccgggaccgcugggacugcaucaugaccuccuaccaguaccucaucauccagaacaccacgugggaggaccacugccaguucagccggcccucccccaucggguaccugggccugcucagccagcgcacccgggacaucuacaucagccgccggcugcuggggaccuucaccuggacgcucuccgacagcgagggcaaggacaccccgggcggguacugccugacccgcuggaugcugaucgaggccgagcucaagugcuucggcaacaccgccgucgccaagugcaacgagaagcacgacgaggaguucugcgacaugcugcggcuguucgacuucaacaagcaggccauccagcgccucaaggcggaggcccagauguccauccagcugaucaacaaggccgugaacgcccugaucaacgaccagcucaucaugaagaaccaccuccgggacaucauggggauccccuacugcaacuacagcaaguacugguaccugaaccacacgaccaccggcaagaccucccugcccaagugcuggcuggugagcaacggguccuaccugaacgagacgcacuucagcgacgacaucgagcagcaggccgacaacaugaucaccgagaugcuccagaaggaguacauggagcgccagggcaagacgccccugggccuggucgaccucuucguguucuccaccagcuucuaccugaucuccaucuuccugcaccuggugaagaucccgacccaccggcacaucgucggcaagagcugccccaagccccaccgccucaaccacauggggaucugcuccugcgggcuguacaagcagcccggcgugccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5908 - RNA, 1658 nt, Artificial Sequence
  mRNA product Design3 comprising derived and/or modified sequence from Lassa virus__AIT17134__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcgggcuguacaagcagcccggcgugccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5909 - RNA, 1658 nt, Artificial Sequence
  mRNA product Design3 comprising derived and/or modified sequence from Lassa virus__AIT17138__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccucccugaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccagccacugcgggacgguggccaacggcguccugcagaccuucaugcggauggccuggggcggguccuacaucgcgcuggacagcggccgcgggggcugggacugcaucaugaccuccuaccaguaccucaucauccagaacaccacgugggaggaccacugccaguucagccggcccucccccaucggguaccugggccugcucagccagcgcacccgggacaucuacaucagccgccggcugcugggcaccuucaccuggacgcucuccgacagcgaggggaaggacaccccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggccauccagcgccucaaggcggaggcccagauguccauccagcugaucaacaaggccgugaacgcccugaucaacgaccagcucaucaugaagaaccaccuccgggacaucauggggauccccuacugcaacuacagcaaguacugguaccugaaccacacgaccaccggccgcaccucccugccccggugcuggcuggucagcaacggcuccuaccugaacgagacgcacuucagcgacgacaucgagcagcaggccgacaacaugaucaccgagaugcuccagaaggaguacauggagcgccaggggaagacgccccugggccugguggaccuguucguguucuccaccagcuucuaccucaucuccaucuuccugcaccuggucaagaucccgacccaccggcacaucgugggcaagagcugccccaagccccaccgccucaaccacauggggaucugcuccugcgggcuguacaagcagcccggcgugccggucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5910 - RNA, 1658 nt, Artificial Sequence
  mRNA product Design3 comprising derived and/or modified sequence from Lassa virus__AIT17142__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggcaucgucgggcuggugacguuccugcuccugugcggccgcuccugcaccaccagccuguacaaggggguguacgagcuccagacccuggagcugaacauggagacgcucaacaugaccaugccgcuguccugcaccaagaacaacagccaccacuacaucauggucggcaacgacaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacuccuacgccggggacgcggccgaccacugcggcacgguggccaacgggguccugcagaccuucaugcggauggccuggggcggcagcuacaucgcgcuggacuccgggcgcggccggugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugcccaagugcuggcuggucuccaacggcagcuaccugaacgagacgcacuucuccgacgacaucgagcagcaggccgacaacaugaucaccgagaugcuccagaaggaguacauggagcggcaggggaagacgccccugggccugguggaccucuucguguucagcaccuccuucuaccugaucagcaucuuccugcaccuggucaagaucccgacccaccgccacaucguggggaagcccugccccaagccccaccggcucaaccacaugggcaucugcuccugcgggcuguacaagcagccgggcgugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5911 - RNA, 1658 nt, Artificial Sequence
  mRNA product Design3 comprising derived and/or modified sequence from Lassa virus__AIT17146__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggccggugggacugcaucaugaccagcuaccaguaccugaucauccagaacaccacgugggaggaccacugcuccuucagccgccccucccccaucggguaccucggccugcugagccagcggacccgcgacaucuacaucagccggcgccuccugggcaccuucaccuggacgcuguccgacagcgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagauguccauccagcucaucaacaaggccgugaacgcccugaucaacgaccagcugaucaugaagaaccaccuccgcgacaucauggggauccccuacugcaacuacagcaaguacugguaccugaaccacacgaccaccggcaagaccucccugcccaagugcuggcucgugagcaacggcuccuaccugaacgagacgcacuucagcgacgacaucgagcagcaggccgacaacaugaucaccgagaugcugcagaaggaguacauggagcggcaggggaagacgccccucggccuggucgaccuguucguguucuccaccagcuucuaccugaucuccaucuuccuccaccuggugaagaucccgacccaccgccacaucgucggcaagagcugccccaagccccaccggcugaaccacauggggaucugcuccugcggguucuacaagcagcccggcgugccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5912 - RNA, 1658 nt, Artificial Sequence
  mRNA product Design3 comprising derived and/or modified sequence from Lassa virus__AIT17154__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggcaucguggggcuggucuccuuccugcuccugugcggccgcagcugcacgaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacagcuacgccggggacgcggccaaccacugcggcaccaucgccaacggggugcugcagacguucaugcggauggccuggggcggcuccuacaucgcgcuggacagcgggcgcgaccggugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaaggacacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccagcggcucaaggcggaggcccagauguccauccagcugaucaacaaggccgucaacgcccugaucaacgaccagcucaucaugaagaaccaccuccgcgacaucaugggcauccccuacugcaacuacagcaaguacugguaccugaaccacaccacgaccgggaagaccucccugcccaagugcuggcuggugagcaacggcuccuaccugaacgagacccacuucagcgacgacaucgagcagcaggccgacaacaugaucacggagaugcuccagaaggaguacauggagcggcagggcaagaccccgcuggggcugguggaccucuucgucuucuccaccagcuucuaccugaucuccaucuuccugcaccuggugaagaucccgacccaccgccacguggucggcaagagcugccccaagccccaccggcucaaccacauggggaucugcuccugcggccuguacgggcagcccggcgugccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5913 - RNA, 1658 nt, Artificial Sequence
  mRNA product Design3 comprising derived and/or modified sequence from Lassa virus__AIT17158__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaaguccugccccaagccccaccggcugaaccacauggggaucugcagcugcggccuguacaagcagcccggggugccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5914 - RNA, 1658 nt, Artificial Sequence
  mRNA product Design3 comprising derived and/or modified sequence from Lassa virus__AIT17164__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccagcucccucuacaaggggguguacgagcugcagacccuggagcucaacauggagacccugaacaugacgaugccgcugagcugcaccaagaacaacucccaccacuacauccgggugggcaacgagaccggccucgagcugacccugacgaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgccggggacgcggccaagcacugcggcaccguggccaacggggugcugcagacguucaugcgcauggccuggggcggcuccuacaucgcgcucgacagcgggcacggcaacugggacugcaucaugaccuccuaccaguaccugaucauccagaacaccaccugggaggaccacugccaguucagccggcccucccccaucggguaccugggccuccugagccagcgcacgcgggacaucuacaucagccgccggcugcucggcaccuucaccuggacccuguccgacagcgaggggaacgacgccccgggcggguacugccugacgcgcuggaugcucauccaggccgagcugaagugcuucggcaacaccgccgucgccaagugcaacgagaagcacgacgaggaguucugcgacaugcugcggcuguucgacuucaacaagcaggcgauccagcgccugaaggccgaggcccagauguccauccagcugaucaacaaggccgugaacgcccucaucaacgaccagcugaucaugaagaaccaccuccgggacaucauggggauccccuacugcaacuacagcaaguacugguaccucaaccacaccaccacgggccgcaccucccugccccggugcuggcuggugagcaacggcuccuaccucaacgagacccacuucagcgacgacaucgagcagcaggcggacaacaugaucaccgagaugcugcagaaggaguacauggagcgccaggggaagacgccccugggccucgucgaccuguucguguucuccaccagcuucuaccugaucuccaucuuccugcaccucgugaagaucccgacccaccggcacaucgucggcaagagcugccccaagccccaccgccugaaccacauggggaucugcuccugcgggcuguucaagcagcccggcgugccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5915 - RNA, 1658 nt, Artificial Sequence
  mRNA product Design3 comprising derived and/or modified sequence from Lassa virus__AIT17168__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcugcucaccuuccugcugcucugcggccgcuccugcaccgccagccgguacaagggggucuacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgcgggggacgccgccaaccacugcggcaccgucgccaacggggugcugcagacguucaugcgcauggcguggggcggcagcuacaucgcccucgacuccgggcacggcagcugggacugcaucaugaccuccuaccaguaccugaucauccagaacaccaccugggaggaccacugccaguucagccggcccucccccaucggguaccugggccuccugagccagcgcacgcgggacaucuacaucagccgccggcugcucggcaccuucaccuggacccuguccgacagcgaggggaaggacacgccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggcgauccagcgccugaaggccgaggcccagauguccauccagcugaucaacaaggccgucaacgcccucaucaacgaccagcugaucaugaagaaccaccuccgggacaucauggggauccccuacugcaacuacagcaaguacugguaccucaaccacaccacgaccggcaagaccucccugcccaagugcuggcuggugagcaacggcuccuaccucaacgagacccacuucagcgacgacaucgagcagcaggcggacaacaugaucacggagaugcugcagaaggaguacauggagcgccaggggaagacgccccugggccucguggaccuguucgucuucuccaccagcuucuaccugaucuccaucuuccugcaccucgugaagaucccgacccaccggcacaucgugggcaagagcugccccaagccccaccgccugaaccacauggggaucugcuccugcgggcuguacaagcagcccggcgucccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5916 - RNA, 1658 nt, Artificial Sequence
  mRNA product Design3 comprising derived and/or modified sequence from Lassa virus__AIT17172__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaagcccugcccccggccccaccgccugaaccacaugggcaucugcuccugcgggcuguacaagcagccgggcgugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5917 - RNA, 1658 nt, Artificial Sequence
  mRNA product Design3 comprising derived and/or modified sequence from Lassa virus__AIT17176__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucaucacguuccugcugcucugcggccgcuccugcaccaccaaccuguacaagggggucuacgagcugcaggcccucgagcugaacauggagacccugaacaugacgaugccgcucagcugcaccaagaacaacucccaccacuacaucauggugggcaacgagaccggccuggagcugacccucacgaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgggggccggaucagcgugcaguacaaccugucccacagcuacgcgggggacgccgccucccacugcggcaccaucgccaacgggguccuccagacguucaugcgcauggcguggggcggcagcuacaucgcccuggacuccgggcacggcgggugggacugcaucaugaccagcuaccaguaccugaucauccagaacaccaccugggaggaccacugccaguucucccggcccagccccaucggcuaccucggccugcugucccagcgcacgcgggacaucuacaucagccgccggcuccuggggaccuucaccuggacccugagcgacuccgagggcaaggacacgcccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggcgauccagcgccugaaggccgaggcccagaugagcauccagcucaucaacaaggccgugaacgcccugaucaacgaccagcugaucaugaagaaccaccuccgggacaucaugggcaucccguacugcaacuacuccaaguacugguaccugaaccacaccgucacgggcaagaccagccugcccaagugcuggcucguguccaacgggagcuaccugaacgagacccacuucuccgacgacaucgagcagcaggcggacaacaugaucaccgagaugcugcagaaggaguacauggagcgccagggcaagacgccccucgggcugguggaccuguucgucuucagcaccuccuucuaccugaucagcaucuuccuccaccuggugaagaucccgacccaccggcacguggucggcaagcccugccccaagccccaccgccugaaccacauggggaucugcuccugcggccucuacaagcagccgggcgugcccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5918 - RNA, 1658 nt, Artificial Sequence
  mRNA product Design3 comprising derived and/or modified sequence from Lassa virus__AIT17180__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcagacgcuggagcucaacauggagacccugaacaugaccaugccgcugagcugcaccaagaacaacucccaccacuacauccgggugggcaacgagacgggccucgagcugacccugaccaacaccagcaucaucaaccacaaguucugcaaccucuccgacgcccacaagaagaaccuguacgaccacgcccugaugagcaucaucuccacguuccaccucagcauccccaacuucaaccaguacgaggccauguccugcgacuucaacgggggcaagaucagcguccaguacaaccugucccacagcuacgccggggacgcggccaaccacugcggcaccguggccaacggggugcugcagaccuucaugcgcauggccuggggcggcuccuacaucgcgcucgacagcgggcggggcaacugggacugcaucaugaccuccuaccaguaccugaucauccagaacacgaccugggacgaccacugccaguucagccgccccucccccaucggguaccugggccuccugagccagcggacccgcgacgucuacaucucccggcgccugcucggcaccuucacguggacccugagcgacagcgaggggaaggacaccccgggcggguacugccugacccgguggaugcucaucgaggccgagcugaagugcuucggcaacacggccguggccaagugcaacgagaagcacgacgaggaguucugcgacaugcugcgccucuucgacuucaacaagcaggccauccagcggcugaaggcggaggcccagauguccauccagcugaucaacaaggccgugaacgcccucaucaacgaccagcugaucaugaagaaccaccuccgcgacaucauggggauccccuacugcaacuacagcaaguacugguaccugaacaacaccgccaccggcaagaccucccugcccaagugcuggcugaucagcaacggcuccuaccucaacgagacgcacuucagcgacgacaucgagcaggaggcggacaacaugaucaccgagaugcugcagaaggaguacauggagcggcaggggaagacgccccugggccucgucgaccuguucguguucuccaccagcuucuaccugaucuccaucuuccugcaccucgugaagaucccgacccaccgccacaucgucggcaagagcugccccaagccccaccggcugaaccacauggggaucugcuccugcgggcuguacaagcagcccggcgugccggugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5919 - RNA, 1658 nt, Artificial Sequence
  mRNA product Design3 comprising derived and/or modified sequence from Lassa virus__AIT17184__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucaccuuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgggggacgccgccaaccacugcggcacgguggccaacggggugcugcagaccuucaugcgcauggcguggggcggcuccuacaucgcccucgacagcgggcggaacggcugggacugcaucaugaccuccuaccaguaccugaucauccagaacaccacgugggacgaccacugccaguucagccgccccucccccaucggguaccugggccuccugagccagcggacccgcgacaucuacaucucccggcgccugcucggcaccuucaccuggacgcugagcgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggcgauccggcgccugaaggccgaggcccagauguccauccagcugaucaacaaggccgugaacgcccucaucaacgaccagcugaucaugaagaaccaccuccgggacaucauggggauccccuacugcaacuacagcaaguacugguaccugaacaacacggcgaccggcaagaccucccugccccgcugcuggcuggugagcaacggcuccuaccucaacgagacccacuucagcgacgacaucgagcagcaggccgacaacaugaucacggagaugcugcagcgggaguacauggagcgccaggggaagacgccccugggccucgucgaccuguucguguucuccaccagcuucuaccugaucuccaucuuccugcaccucgugaagaucccgacccaccggcacaucgucgggaagcccugccccaagccccaccgccugaaccacaugggcaucugcagcugcgggcuguacaagcagccgggcgugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5920 - RNA, 1658 nt, Artificial Sequence
  mRNA product Design3 comprising derived and/or modified sequence from Lassa virus__AIT17188__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggcuucguggggcuggucuccuuccugcuccugugcggccgcagcugcacgaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacagcuacgccguggacgcggccaaccacugcgggaccguggccaacggcguccugcagacguucaugcggauggccuggggcggguccuacaucgcgcuggacagcggccacggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaaggacacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccagcggcuccgcgcggaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccacgaccgggcgcaccagccugcccaagugcuggcuggucuccaacggcagcuaccugaacgagacccacuucuccgacgacaucgagcagcaggccgacaacaugaucacggagaugcuccagaaggaguacauggagcggcagggcaagaccccgcuggggcugguggaccucuucguguucagcaccuccuucuaccugaucagcaucuuccugcaccuggucaagaucccgacccaccgccacaucgugggcaaguccugccccaagccccaccggcucaaccacauggggaucugcagcugcggccuguacgggcagcccggcgugccggucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5921 - RNA, 1658 nt, Artificial Sequence
  mRNA product Design3 comprising derived and/or modified sequence from Lassa virus__AIT17192__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggcuucaucgggcugguguccuuccugcuccugugcggccgcagcugcacgaccucccuguacaagggggucuacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguucgaggccauguccugcgacuucaacgggggcaagaucagcgugcaguacaaccucucccacagcuacgccgucgacgcggccaaccacugcgggaccguggccaacggcgugcugcagacguucaugcggauggccuggggcggguccuacaucgcgcuggacagcggccacggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaaggacacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucaugggcauccccuacugcaacuacuccaaguacugguaccugaaccacaccacgaccgggcggaccagccugcccaagugcuggcugguguccaacggcagcuaccugaacgagacccacuucuccgacgacaucgagcagcaggccgacaacaugaucacggagaugcuccagaaggaguacauggagcgccagggcaagaccccgcuggggcuggucgaccucuucguguucagcaccuccuucuaccugaucagcaucuuccugcaccuggugaagaucccgacccaccggcacaucgucggcaaguccugccccaagccccaccgccucaaccacauggggaucugcagcugcggccuguacgggcagcccggcgugccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5922 - RNA, 1658 nt, Artificial Sequence
  mRNA product Design3 comprising derived and/or modified sequence from Lassa virus__AIT17196__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggccggugggacugcaucaugaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugaacauccagcucaucaacaaggccgugaacgcccugaucaacgaccagcugaucaugaagaaccaccuccgcgacaucauggggauccccuacugcaacuacagcaaguacugguaccugaaccacacgaccaccggcaagaccucccugccccggugcuggcucgugagcaacggcuccuaccugaacgagacgcacuucagcgacgacaucgagcagcaggccgacaacaugaucaccgagaugcugcagaaggaguacauggagcgccaggggaagacgccccucggccuggucgaccuguucguguucuccaccagcuucuaccugaucuccaucuuccuccaccuggugaagaucccgacccaccggcacaucgucgggaagcccugccccaagccccaccgccugaaccacaugggcaucugcagcugcggguucuacaagcagccgggcgugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5923 - RNA, 1658 nt, Artificial Sequence
  mRNA product Design3 comprising derived and/or modified sequence from Lassa virus__AIT17204__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccagcucccuguacaaggggguguacgagcugcagacccucgagcugaacauggagacccugaacaugacgaugccgcucagcugcaccaagaacuccagccaccacuacauccgggugggcaacgagaccggccuggagcugacccucacgaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcaccguggccaacggggugcuccagacguucaugcgcauggccuggggcggcagcuacaucgcgcuggacuccgggcacgaccggugggacugcaucaugaccagcuaccaguaccugaucauccagaacaccaccugggaggaccacugccaguucucccgccccagccccaucggcuaccucgggcugcugagccagcggacgcgcgacaucuacaucucccggcgccuccugggcaccuucaccuggacccugagcgacuccgagggcaaggacacgcccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcaucccguacugcaacuacuccaaguacugguaccugaaccacaccaucacggggaagaccagccugcccaagugcuggcucguguccaacggcagcuaccugaacaagacccacuucuccgacgacaucgagcagcaggccgacaacaugaucaccgagaugcugcagaaggaguacauggagcggcagggcaagacgccccucgggcuggucgaccuguucguguucagcaccuccuucuaccugaucagcaucuuccuccaccugaucaagaucccgacccaccgccacaucgugggcaagcccugccccaagccccaccggcugaaccacauggggaucugcuccugcggccucuacaagcagccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5924 - RNA, 1658 nt, Artificial Sequence
  mRNA product Design3 comprising derived and/or modified sequence from Lassa virus__AIT17208__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggccagugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5925 - RNA, 1658 nt, Artificial Sequence
  mRNA product Design3 comprising derived and/or modified sequence from Lassa virus__AIT17210__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcgaccggugggacugcaucaugaccagcuaccaguaccugaucauccagaacaccacgugggaggaccacugccaguucucccgccccagccccaucggcuaccucgggcugcugucccagcggacccgcgacaucuacaucagccggcgccuccugggcaccuucaccuggacgcugagcgacuccgagggcaaggacacccccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcauccccuacugcaacuacuccaaguacugguaccugaaccacacgaccaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcagggcaagaccccgcucgggcuggucgaccuguucguguucagcaccuccuucuaccugaucagcaucuuccuccgccuggugaagaucccgacgcaccggcacaucgucggcaagcccugccccaagccccaccgccugaaccacauggggaucugcuccugcggccucuacaagcagccgggggugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5926 - RNA, 1658 nt, Artificial Sequence
  mRNA product Design3 comprising derived and/or modified sequence from Lassa virus__AIT17212__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccaccggaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcgcauggccuggggcggcagcuacaucgcgcuggacuccgggcggggcaagugggacugcaucaugaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucauggggauccccuacugcaacuacuccaaguacugguaccugaaccacacgaccaccggcaagaccagccugccccggugcuggcucguguccaacggcagcuaccugaacgagacgcacuucuccgacgacaucgagcagcaggccgacaacaugaucaccgagaugcugcagaaggaguacauggagcgccaggggaagacgccccucggccuggucgaccuguucguguucagcaccuccuucuaccugaucagcaucuuccuccaccuggugaagaucccgacccaccggcacaucgucgggaagcccugccccaagccccaccgccugaaccacaugggcaucugcuccugcgggcucuacaagcagccgggcgugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5927 - RNA, 1658 nt, Artificial Sequence
  mRNA product Design3 comprising derived and/or modified sequence from Lassa virus__AIT17216__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggccgcugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugccccaagccccaccgccugaacuacaugggcaucugcuccugcgggcuguacaagcagccgggcgugcccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5928 - RNA, 1658 nt, Artificial Sequence
  mRNA product Design3 comprising derived and/or modified sequence from Lassa virus__AIT17224__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgacaccggccucgagcugacgcugaccaacaccagcaucauccagcacaaguucugcaaccucuccgacgcccacaagaagaaccuguacgaccacacccugaugagcaucaucuccacguuccaccucagcauccccaacuucaaccaguacgaggccauguccugcgacuucaacgggggcaagaucagcguccaguacaaccugucccacagcuacgccggggacgcggccucccacugcggcaccguggccaacggggugcugcagaccuucaugcgcauggccuggggcggcagcuacaucgcgcucgacuccgggcggggcaacugggacugcaucaugaccagcuaccaguaccugaucauccagaacacgaccugggaggaccacugccaguucucccgccccagccccaucggguaccugggccuccugucccagcggacccgcgacaucuacaucagccggcgccugcucggcaccuucacguggacccugagcgacuccgaggggcgggacaccccgggcggguacugccugacccgcuggaugcucaucgaggccgagcugaagugcuucggcaacacggccgucgccaagugcaacgagaagcacgacgaggaguucugcgacaugcugcggcuguucgacuucaacaagcaggccauccagcgccugaagaccgaggcgcagaugagcauccagcugaucaacaaggccgugaacgcccucaucaacgaccagcugaucaugaagaaccaccuccgggacaucauggggauccccuacugcaacuacuccaaguacugguaccucaacaacaccaucaccggcaagagcucccugcccaagugcuggcuggugagcaacggcuccuaccucaacgagacgcacuucagcgacgacaucgagcaggaggccgacaacaugaucaccgagaugcugcagaaggaguacauggagcgccaggggaagacgccccugggccucgucgaccuguucguguucuccaccagcuucuaccugaucuccaucuuccugcaccucgugaagaucccgacccaccggcacaucgucgggaagcccugccccaagccccaccgccugaaccacaugggcgugugcagcugcgggcuguacaagcagccgggcgugcccguccgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5929 - RNA, 1658 nt, Artificial Sequence
  mRNA product Design3 comprising derived and/or modified sequence from Lassa virus__AIT17228__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcugcucacguuccugcugcucugcggccgcuccugcaccaccagccuguacaagggggucuacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccggggacgcggccaaccacugcggcacggucgccaacggggugcuccagaccuucaugcggauggccuggggcggcagcuacaucgcgcuggacuccgggcgcggcgggugggacugcaucaugaccagcuaccaguaccugaucauccagaacaccacgugggaggaccacugccaguucucccggcccagccccaucggcuaccucggccugcugucccagcgcacccgggacaucuacaucagccgccggcuccuggggaccuucaccuggacgcugagcgacuccgagggcaaggacacccccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaaggcggaggcccagaugagcauccagcucaucaacaaggccgucaacgcccugaucaacgaccagcugaucaugaagaaccaccuccgggacaucaugggcauccccuacugcaacuacuccaaguacugguaccugaaccacacgaccaccggcaagaccagccugcccaagugcuggcucguguccaacgggagcuaccugaacgagacgcacuucuccgacgacaucgagcagcaggccgacaacaugaucaccgagaugcugcagaaggaguacauggagcgccagggcaagaccccgcucgggcugguggaccuguucgucuucagcaccuccuucuaccugaucagcaucuuccuccaccuggugaagaucccgacgcaccggcacaucgugggcaaguccugccccaagccccaccgccugaaccacauggggaucugcagcugcggccucuacaagcagcccggcgucccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5930 - RNA, 1658 nt, Artificial Sequence
  mRNA product Design3 comprising derived and/or modified sequence from Lassa virus__AIT17232__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgaggggaagaucuccguccaguacaaccugagccacuccuacgccggcgacgcggccaaccacugcgggacgguggccaacggcgugcugcagaccuucaugcgcauggccuggggcgggagcuacaucgcgcucgacuccggccgggggaagugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccaucgagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaaguccugccccaagccccaccggcugaaccacauggggaucugcagcugcggccuguacaagcagcccggggugccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5931 - RNA, 1658 nt, Artificial Sequence
  mRNA product Design3 comprising derived and/or modified sequence from Lassa virus__AIT17236__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggccggaucuccguccaguacaaccugagccacuccuacgccggggaggcggccaaccacugcggcacgguggccaacggggugcugcagaccuucaugcgcauggccuggggcggcagcuacaucgcgcucgacuccgggcggggcaagugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacucccgguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaaguccugccccaagccccaccgccugaaccacaugggcaucugcagcugcgggcuguacaagcagcccggcgugccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5932 - RNA, 1658 nt, Artificial Sequence
  mRNA product Design3 comprising derived and/or modified sequence from Lassa virus__AIT17240__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaagggguucuacgagcugcagacccucgagcugaacauggagacgcugaacaugaccaugccgcucuccugcaccaagaacaacagccaccacuacauccgggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccggggacgcggccaaccacugcggcacggucgccaacggggugcuccagaccuucaugcgcauggccuggggcggcagcuacaucgcgcuggacuccgggcggggccgcugggacugcaucaugaccagcuaccaguaccugaucauccagaacaccacgugggaggaccacugccaguucucccggcccagccccaucggguaccucggccugcugucccagaagacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccauccagcggcugaaggcggaggcccagaugagcauccagcucaucaacaaggccgucaacgcccugaucaacgaccagcugaucaugaagaaccaccuccgcgacaucauggggauccccuacugcaacuacuccaaguacugguaccugaaccacacgaccaccggcaagaccagccugcccaagugcuggcucguguccaacggcagcuaccugaacgagacgcacuucuccgacgacaucgagcagcaggccgacaacaugaucaccgagaugcugcagaaggaguacauggagcggcaggggaagacgccccucggccugguggaccuguucgucuucagcaccuccuucuaccugaucagcaucuuccuccaccuggugaagaucccgacccaccgccacaucguggggaaguccugccccaagccccaccggcugaaccacaugggcaucugcagcugcgggcucuacaagcagcccggcgucccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5933 - RNA, 1658 nt, Artificial Sequence
  mRNA product Design3 comprising derived and/or modified sequence from Lassa virus__AIT17244__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucaccuuccugcugcucugcggccgcuccugcaccaccaaccuguacaaggggguguacgagcugcagacccucgagcugaacauggagacgcugaacaugaccaugccgcucagcugcaccaagaacuccagccaccacuacauccgggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgugggggacgccgcggaccacugcggcacgguggccaacgggguccuccagaccuucaugcgcauggccuggggcggcagcuacaucgcccuggacuccgggcggggcaagugggacugcaucaucaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggcggagcugaagugcuucggcaacaccgccguggccaagugcaacgagaagcacgacgaggaguucugcgacaugcuccgccuguucgacuucaacaagcaggccauccagcggcugaaggccgaggcgcagaugagcauccagcucaucaacaaggccgugaacgcccugaucaacgaccagcugaucaugaagaaccaccuccgcgacaucauggggauccccuacugcaacuacuccaaguacugguaccugaaccacacgaucaccggcaagaccagccugccccggugcuggcucgucuccaacggcagcuaccugaacgagacccgcuucuccgacgacaucgagcagcaggccgacaacaugaucacggagaugcugcagaaggaguacauggagcggcaggggaagacgccccucggccugguggaccuguucguguucagcaccuccuucuaccugaucagcaucuuccuccaccuggucaagaucccgacccaccgccacaucguggggaagcccugccccaagccccaccggcugaaccacaugggcaucugcuccugcgggcucuacaagcagccgggcgugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5934 - RNA, 1658 nt, Artificial Sequence
  mRNA product Design3 comprising derived and/or modified sequence from Lassa virus__AIT17246__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucaucacguuccugcugcucugcggccgcuccugcaccaccaaccuguacaagggggucuacgagcugcagacccucgagcugaacauggagacgcugaacaugaccaugccgcucagcugcaccaagaacuccagccaccacuacaucauggugggcaacgagaccggccuggagcugacgcucaccaacaccuccaucaucaaccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccgugcaguacaaccugagccacuccuacgccgucgacgccgcgaaccacugcgggaccguggccaacggcauccuccagaccuucaugcggauggccuggggcgggagcuacaucgcccuggacuccggccgcgggaacugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagaugagcauccagcucaucaacaaggccgucaacgcccugaucaacgaccagcugaucaugaagaaccaccuccgggacaucaugggcauccccuacugcaacuacuccaaguacugguaccugaaccacaccaccaccgggaagacgagccugcccaagugcuggcucguguccaacggcagcuaccugaacgagacccacuucuccgacgacaucgagcagcaggccgacaacaugaucaccgagaugcugcagaaggaguacauggagcgccagggcaagaccccgcucgggcugguggaccuguucgucuucagcacguccuucuaccugaucagcaucuuccuccaccuggugaagaucccgacccaccggcacaucgugggcaagcccugccccaagccccaccgccugaaccacauggggaucugcuccugcggccucuacaagcagccggggguccccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5935 - RNA, 1658 nt, Artificial Sequence
  mRNA product Design3 comprising derived and/or modified sequence from Lassa virus__AIT17250__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacacccucaugagcaucaucuccacguuccaccugagcauccccaacuucaaccaguacgaggccauguccugcgacuucaacgggggcaagaucagcguccaguacaaccugucccacagcuacgccguggacgccgcgaaccacugcgggaccguggccaacggcguccuccagaccuucaugcggauggccuggggcggguccuacaucgcccuggacagcggccgcgggaacugggacugcaucaugaccuccuaccaguaccugaucauccagaacacgaccugggaggaccacugccaguucagccggcccucccccaucggcuaccucgggcugcugagccagcgcacccgggacaucuacaucucccgccggcuccugggcaccuucacguggacccugagcgacagcgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagauguccauccagcucaucaacaaggccgugaacgcccugaucaacgaccagcugaucaugaagaaccaccuccgggacaucaugggcauccccuacugcaacuacagcaaguacugguaccugaaccacaccaccaccgggaagacgucccugcccaagugcuggcucgucagcaacggcuccuaccugaacgagacccacuucagcgacgacaucgagcagcaggccgacaacaugaucaccgagaugcugcagaaggaguacauggagcgccagggcaagaccccgcucgggcugguggaccuguucguguucuccacgagcuucuaccugaucuccaucuuccuccaccuggucaagaucccgacccaccggcacaucgugggcaagcccugccccaagccccaccgccugaaccacauggggaucugcagcugcggccucuacaagcagccgggggugcccguccgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5936 - RNA, 1658 nt, Artificial Sequence
  mRNA product Design3 comprising derived and/or modified sequence from Lassa virus__AIT17254__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggcaucguggggcuggucacguuccugcuccugugcggccgcuccugcaccaccagccuguacaaggggguguacgagcuccagacccuggagcugaacauggagacgcucaacaugaccaugccgcuguccugcaccaagaacaacagccaccacuacaucauggugggcaacgagaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccggggacgcggccaaccacugcggcacgguggccaacggggugcugcagaccuucaugcggauggccuggggcggcagcuacaucgcgcuggacuccgggcgcgaccggugggacugcaucaugaccagcuaccaguaccucaucauccagaacaccacgugggaggaccacugccaguucucccgccccagccccaucggcuaccuggggcugcucucccagcggacccgcgacaucuacaucagccggcgccugcugggcaccuucaccuggacgcucagcgacuccgagggcaagaacacccccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggccauccagcggcucaaggcggaggcccagaugagcaucucccugaucaacaaggccgugaacgcccugaucaacgaccagcucaucaugaagaaccaccuccgcgacaucaugggcauccccuacugcaacuacagcaaguacugguaccugaaccacacgaccaccgggaagaccucccugccccggugcuggcuggugagcaacggcuccuaccugaacgagacgcacuucagcgacgacaucgagcagcaggccgacaacaugaucaccgagaugcuccagaaggaguacauggaccgccagggcaagaccccgcuggggcuggucgaccucuucguguucuccaccagcuucuaccugaucuccaucuuccugcaccuggugaagaucccgacgcaccggcacaucgucggcaagaccugccccaagccccaccgccucaaccacauggggaucugcagcugcggccuguacaagcagcccggggugccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5937 - RNA, 1658 nt, Artificial Sequence
  mRNA product Design3 comprising derived and/or modified sequence from Lassa virus__AIT17258__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucgucagcaccuuccaccucuccauccccaacuucaaccaguacgaggccaugagcugcgacuucaacgggggcaagaucuccgugcaguacaaccugagccacuccuacgccguggacgcggccaaccacugcgggacggucgccaacggcgugcugcagaccuucaugcggauggccuggggcgggagcuacaucgcgcucgacuccggccgcgggggcugggacugcaucaugaccagcuaccaguaccugaucauccagaacgugaccugggaggaccacugccaguucucccggcccagccccaucggguaccugggccuccugucccagcgcacgcgggacgucuacaucagccgccggcugcucggcaccuucaccuggacccugagcgacuccgaggggaacgacacgccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacaccacgaccggcaagaccagccugcccaagugcuggcuggucuccaacggcagcuaccucaacgagacccacuucuccgacgacaucgagcagcaggccgacaacaugaucacggagaugcugcagaaggaguacauggagcgccaggggaagacgccccugggccucguggaccuguucguguucagcaccuccuucuaccugaucagcaucuuccugcaccucgucaagaucccgacccaccggcacaucguggggaagcccugccccaagccccaccgccugaaccacaugggcaucugcuccugcgggcuguacaagcagccgggcgugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5938 - RNA, 1658 nt, Artificial Sequence
  mRNA product Design3 comprising derived and/or modified sequence from Lassa virus__AIT17262__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccacgcacugcggcaccguggccaacggggugcuccagaccuucaugcggauggccuggggcggcagcuacaucgcgcuggacuccgggcgcggcaagugggacugcaucaugaccagcuaccaguaccugaucauccagaacacgaccugggaggaccacugccaguucucccggcccagccccaucggguaccucggccugcugucccagcgcacccgggacaucuacaucagccgccggcuccugggcaccuucacguggacccugagcgacuccgaggggaaggacaccccgggcggguacugccucacccgcuggaugcugaucgaggccgagcugaagugcuucggcaacacggccgucgccaagugcaacgagaagcacgacgaggaguucugcgacaugcuccggcuguucgacuucaacaagcaggccauccagcgccugaagaccgaggcgcagaugagcauccagcucaucaacaaggccgugaacgcccugaucaacgaccagcugaucaugaagaaccaccuccgggacaucauggggauccccuacugcaacuacuccaaguacugguaccugaaccacaccaccacgggcaagaccagccugccccgcugcuggcucguguccaacggcagcuaccugaacgagacccacuucuccgacgacaucgagcagcaggccgacaacaugaucaccgagaugcugcagaaggaguacauggagcggcaggggaagacgccccucggccuggucgaccuguucguguucagcaccuccuucuaccugaucagcaucuuccuccaccuggugaagaucccgacccaccgccacaucgucgggaagcccugccccaagccccaccggcugaaccacaugggcaucugcuccugcgggcucuacaagcagccgggcgugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5939 - RNA, 1658 nt, Artificial Sequence
  mRNA product Design3 comprising derived and/or modified sequence from Lassa virus__AIT17266__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccucccugaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccaaccacugcgggacgguggccaacggcguccugcagaccuucaugcggauggccuggggcgggagcuacaucgcgcuggacuccggccgcgggggcugggacugcaucaugaccagcuaccaguaccucaucauccagaacaccacgugggaggaccacugccaguucucccggcccagccccaucggguaccugggccugcucucccagcgcacccgggacaucuacaucagccgccggcugcugggcaccuucaccuggacgcucagcgacuccgaggggaaggacaccccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggccauccagcgccucaaggcggaggcccagaugagcauccagcugaucaacaaggccgugaacgcccugaucaacgaccagcucaucaugaagaaccaccuccgggacaucauggggauccccuacugcaacuacuccaaguacugguaccugaaccacacgaccaccggccgcaccagccugccccggugcuggcuggucuccaacggcagcuaccugaacgagacgcacuucuccgacgacaucgagcagcaggccgacaacaugaucaccgagaugcuccagaaggaguacauggagcgccaggggaagacgccccugggccugguggaccuguucguguucagcaccuccuucuaccucaucagcaucuuccugcaccuggucaagaucccgacccaccggcacaucguggggaaguccugccccaagccccaccgccucaaccacaugggcaucugcagcugcgggcuguacaagcagcccggcgugccggucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5940 - RNA, 1658 nt, Artificial Sequence
  mRNA product Design3 comprising derived and/or modified sequence from Lassa virus__AIT17270__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacuucgcgaccugcggccuggucgggcuggugaccuuccuccugcugugcggccgcuccugcagcaccuccguguacaagggggucuacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacagcuacgccgucgacgcggccaaccacugcgggaccguggccaacggcgugcugcagacguucaugcggauggccuggggcggguccuacaucgcgcuggacagcggccacgggggcugggacugcaucaugaccaacuaccaguaccucaucauccagaacaccaccugggaggaccacugccaguucucccgccccagccccaucggguaccugggccugcucucccagcggacgcgcgacaucuacaucagccggcgccugcugggcaccuucaccuggacccucagcgacuccgaggggaaggacacgccgggcggguacugccugacccgguggaugcugaucgaggccgagcucaagugcuucggcaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacaccacgaccggccggaccagccugcccaagugcuggcugguguccaacggcagcuaccugaacgagacccacuucuccgacgacaucgagcagcaggccgacaacaugaucacggagaugcuccagcgcgaguacauggagcggcaggggaagacgccccugggccuggucgaccucuucguguucagcaccuccuucuaccugaucagcaucuuccugcaccuggugaagaucccgacccaccgccacaucgucgggaaguccugccccaagccccaccggcucaaccacaugggcaucugcagcugcgggcuguacaagcagcccggcgugccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5941 - RNA, 1658 nt, Artificial Sequence
  mRNA product Design3 comprising derived and/or modified sequence from Lassa virus__AIT17274__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugacggggcuggucgccuuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucgagcaccgcuucugcaaccucuccgacgcccacaagaagaaccuguacgaccacgcccugaugagcaucaucuccaccuuccaccucagcauccccaacuucaaccaguacgaggcgauguccugcgacuucaacgggggcaagaucagcguccaguacaaccugucccacagcuacgccguggacgccgccaaccacugcgggacgguggcgaacggcguccugcagaccuucaugcggauggccuggggcggguccuacaucgcccucgacagcggccgcaacgggugggacugcaucaugaccuccuaccaguaccugaucauccagaacaccacgugggaggaccacugccaguucagccggcccucccccaucggcuaccuggggcuccugagccagcgcacccgggacaucuacaucucccgccggcugcucggcaccuucaccuggacgcugagcgacagcgagggcaaggacacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgccugaaggccgaggcccagauguccauccagcugaucaacaaggccgugaacgcgcucaucaacgaccagcugaucaugaagaaccaccuccgggacaucaugggcauccccuacugcaacuacagcaaguacugguaccucaacaacacggccaccgggaagaccucccugccccgcugcuggcuggucagcaacggcuccuaccucaacgagacccacuucagcgacgacaucgagcagcaggccgacaacaugaucacggagaugcugcagaaggaguacauggagcggcagggcaagaccccgcuggggcucguggaccuguucguguucuccaccagcuucuaccugaucuccaucuuccugcaccucgucaagaucccgacccaccgccacaucgugggcaagcccugccccaagccccaccggcugaaccacauggggaucugcagcugcggccuguacaagcagccgggggcccccgugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5942 - RNA, 1658 nt, Artificial Sequence
  mRNA product Design3 comprising derived and/or modified sequence from Lassa virus__AIT17276__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggcaagugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcgggcuguacaagcagcccggcgugccggugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5943 - RNA, 1655 nt, Artificial Sequence
  mRNA product Design3 comprising derived and/or modified sequence from Lassa virus__AIT17280__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucgaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcgcauggccuggggcggcagcuacaucgcgcucgacuccgggcacgagugggacugcaucaugaccagcuaccaguaccugaucauccagaacaccacgugggacaaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaagguggaggcgcagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcuggucuccaacggcagcuaccucaacgagacgcacuucuccgacgacaucgagcagcaggccgacaacaugaucaccgagaugcugcagaaggaguacauggagcgccagggcaagaccccgcuggggcucguggaccuguucguguucagcaccuccuucuaccugaucagcaucuuccugcaccucgucaagaucccgacgcaccggcacaucgugggcaaguccugccccaagccccaccgccugaaccacauggggaucugcagcugcggcuucuacaagcagcccggggugccggucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5944 - RNA, 1658 nt, Artificial Sequence
  mRNA product Design3 comprising derived and/or modified sequence from Lassa virus__AIT17288__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccguggacgcggccaaccacugcgggacgguggccaacggcguccugcagaccuucaugcggauggccuggggcgggggcuacaucgcgcucgacagcgggcgcggcaacugggacugcaucaugaccuccuaccaguaccugaucauccagaacaccacgugggaggaccacugccaguucagccggcccucccccaucggguaccugggccuccugagccagcgcacccgggacaucuacaucucccgccggcugcucggcaccuucaccuggacgcugagcgacagcgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagauguccauccagcugaucaacaaggccgugaacgcccucaucaacgaccagcugaucaugaagaaccaccuccgggacaucauggggauccccuacugcaacuacagcaaguacugguaccucaaccacacggucaccggcaagaccucccugcccaagugcuggcuggugagcaacggcuccuaccucaacgagacccacuucagcgacgacaucgagcagcaggccgacaacaugaucacggagaugcugcagaaggaguacauggagcgccaggggaagacgccccugggccucguggaccuguucgucuucuccaccagcuucuaccugaucuccaucuuccugcaccucgugaagaucccgacccaccggcacaucgugggcaagagcugccccaagccccaccgccugaaccacauggggaucugcuccugcgggcuguacaagcagcccggcgucccggugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5945 - RNA, 1658 nt, Artificial Sequence
  mRNA product Design3 comprising derived and/or modified sequence from Lassa virus__AIT17292__GPC (opt1)
gggagaaagcuuaccaugggccagaucgugaccuucuuccaggaggucccccacgugaucgaggaggugaugaacaucguccugaucgcccucagcaucauggccgugcugaaggggcuguacaacaucgcgaccugcggccucguggggcuggucacguuccugcuccugugcggccgcuccugcaccaccacccuguacaaggggguguacgagcuccagacgcuggagcugaacauggagacccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcguccaguacaaccucucccacagcuacgccggggacgcggccaaccacugcggcaccguggccaacggggugcugcagaccuucaugcggauggccuggggcggcuccuacaucgcgcuggacagcgggcacggcgggugggacugcaucaugaccuccuaccaguaccucaucauccagaacacgaccugggaggaccacugccaguucacccgccccagccccaucggcuaccugggccugcucucccagcggacccgcgacaucuacaucagccggcgccugcuggggacguucaccuggacccucuccgacagcgagggcaacgacacccccgggggcuacugccugacgcgguggaugcugaucgaggccgagcucaagugcuucgggaacaccgccgucgccaagugcaacgagaagcacgacgaggaguucugcgacaugcugcgccuguucgacuucaacaagcaggccauccagcggcuccgcgcggaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccaccacgggccgcaccagccugccccggugcuggcugguguccaacgggagcuaccugaacgagacccacuucuccgacgacaucgagcagcaggccgacaacaugaucaccgagaugcuccagaaggaguacauggagcgccagggcaagacgccccuggggcuggucgaccucuucguguucagcaccuccuucuaccugaucagcaucuuccugcaccugaucaagaucccgacccaccggcacaucgugggcaagcccugccccaagccccaccgccucaaccacaugggggucugcuccugcggccuguacaagcagccgggcgugcccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5946 - RNA, 1658 nt, Artificial Sequence
  mRNA product Design3 comprising derived and/or modified sequence from Lassa virus__AIT17294__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggcgggugggacugcaucaugaccagcuaccaguaccugaucauccagaacaccacgugggaggaccacugccaguucucccggcccagccccgucggcuaccucggccugcugucccagcgcacccgggacaucuacaucagccgccggcuccuggggaccuucaccuggacgcugagcgacuccgagggcaaggacacccccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaagacggaggcgcagaugagcauccagcucaucaacaaggccgugaacgcccugaucaacgaccagcugaucaugaagaaccaccuccgggacaucaugggcauccccuacugcaacuacuccaaguacugguaccugaaccacaccaccaccggcaagacgagccugccccgcugcuggcucgucuccaacgggagcuaccugaacgagacccacuucuccgacgacaucgagcagcaggccgacaacaugaucaccgagaugcugcagaaggaguacauggagcggcagggcaagaccccgcucgggcugguggaccuguucguguucagcacguccuucuaccugaucagcaucuuccuccaccuggucaagaucccgacccaccgccacaucgugggcaagcccugccccaagccccaccggcugaaccacauggggaucugcuccugcggccucuacaagcagccgggcgugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5947 - RNA, 1658 nt, Artificial Sequence
  mRNA product Design3 comprising derived and/or modified sequence from Lassa virus__AIT17298__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugcuggggcucgugugcuuccugcugcucugcggccgcuccugcaccaccagccuguacaagggggucuacgagcugcagacccucgagcugaacauggagacccugaacaugacgaugccgcucuccugcaccaagaacaacagccaccacuacaucauggugggcaacgagaccggccuggagcugacccucacgaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccgucgacgcggccagccacugcgggaccaucgccaacggcgugcuccagacguucaugcggauggccuggggcggguccuacaucgcgcuggacagcggccacgggggcugggacugcaucaugaccuccuaccaguaccugaucauccagaacaccaccugggaggaccacugccaguucagccgccccucccccaucggguaccucggccugcugagccagcggacgcgcgacaucuacaucagccggcgccuccugggcaccuucaccuggacccuguccgacagcgaggggaaggacacgccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccauccagcggcugaaggcggaggcccagauguccauccagcucaucaacaaggccgucaacgcccugaucaacgaccagcugaucaugaagaaccaccuccgcgacaucauggggauccccuacugcaacuacagcaaguacugguaccugaaccacaccacgaccggcaagaccucccugcccaagugcuggcucgugagcaacggcuccuaccugaacgagacccacuucagcgacgacaucgagcagcaggccgacaacaugaucacggagaugcugcagaaggaguacauggagcggcaggggaagacgccccucggccugguggaccuguucgucuucuccaccagcuucuaccugaucuccaucuuccuccaccuggugaagaucccgacccaccgccacguggucgggaagcccugccccaagccccaccggcugaaccacaugggcaucugcagcugcgggcucuacggccagccgggcgugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5948 - RNA, 1658 nt, Artificial Sequence
  mRNA product Design3 comprising derived and/or modified sequence from Lassa virus__AIT17302__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucucccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccguccaguacaaccugagccacuccuacgccguggacgccgcgaaccacugcgggaccguggccaacggcguccuccagaccuucaugcggauggccuggggcgggagcuacaucgcccuggacuccggccgcgggaacugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagaugagcauccagcucaucaacaaggccgugaacgcccugaucaacgaccagcugaucaugaagaaccaccuccgggacaucaugggcauccccuacugcaacuacuccaaguacugguaccugaaccacaccaccaccgggaagacgagccugcccaagugcuggcucgucuccaacggcagcuaccugaacgagacccacuucuccgacgacaucgagcagcaggccgacaacaugaucaccgagaugcugcagaaggaguacauggagcgccagggcaagaccccgcucgggcugguggaccuguucguguucagcacguccuucuaccugaucagcaucuuccuccaccuggucaagaucccgacccaccggcacaucgugggcaagcccugccccaagccccaccgccugaaccacauggggaucugcuccugcggccucuacaagcagccgggggugcccguccgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5949 - RNA, 1658 nt, Artificial Sequence
  mRNA product Design3 comprising derived and/or modified sequence from Lassa virus__AIT17310__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccacgcacugcggcaccguggccaacggggugcuccagaccuucaugcggauggccuggggcggcagcuacaucgcgcuggacuccgggcgcggcaagugggacugcaucaugaccagcuaccaguaccugaucauccagaacacgaccugggaggaccacugccaguucucccggcccagccccaucggguaccucggccugcugucccagcgcacccgggacaucuacaucagccgccggcuccugggcaccuucacguggacccugagcgacuccgaggggaaggacaccccgggcggguacugccucacccgcuggaugcugaucgaggccgagcugaagugcuucggcaacacggccgucgccaagugcaacgagaagcacgacgaggaguucugcgacaugcuccggcuguucgacuucaacaagcaggccauccagcgccugaagaccgaggcgcagaugagcauccagcucaucaacaaggccgugaacgcccugaucaacgaccagcugaucaugaagaaccaccuccgggacaucauggggauccccuacugcaacuacuccaaguacugguaccugaaccacaccaccacgggcaagaccagccugccccgcugcuggcucguguccaacggcagcuaccugaacgagacccacuucuccgacgacaucgagcagcaggccgacaacaugaucaccgagaugcugcagaaggaguacauggagcggcaggggaagacgccccucggccuggucgaccuguucguguucagcaccuccuucuaccugaucagcaucuuccuccaccuggugaagaucccgacccaccgccacaucgucgggaagcccugccccaagccccaccggcugaacuacaugggcaucugcuccugcgggcucuacaagcagccgggcgugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5950 - RNA, 1658 nt, Artificial Sequence
  mRNA product Design3 comprising derived and/or modified sequence from Lassa virus__AIT17314__GPC (opt1)
gggagaaagcuuaccaugggccagaucgugaccuucuuccaggaggucccccacgugaucgaggaggugaugaacaucguccugaucacccucagcauccuggccgugcugaaggggcucuacaacguggccacgugcggccuggucgggcuggugaccuuccuccugcugugcggccgcuccugcaccaccagccucuacaaggggguguacgagcugcagacgcuggagcucaacauggagacccugaacaugaccaugccgcuguccugcaccaagaacaacagccaccacuacaucauggucggcaacgagacgggccucgagcugacccugaccaacaccuccaucaucaaccacaaguucugcaaccucagcgacgcgcacaagaaggaccuguacgaccacgcccugauguccaucaucagcacguuccaccucuccauccccaacuucaaccaguacgaggccaugagcugcgacuucaacgggggcaagaucuccgugcaguacaaccugagccacuccuacgccguggacgccgcgaaccacugcgggaccgucgccaacggcgugcugcagaccuucaugcggauggccuggggcgggagcuacaucgcccucgacuccggccgcgggggcugggacugcaucaugaccagcuaccaguaccugaucauccagaacacgaccugggaggaccacugccaguucucccggcccagccccaucggguaccugggccuccugucccagcgcacccgggacaucuacaucagccgccggcugcucggcaccuucacguggacccugagcgacuccgaggggaacgacaccccgggcggguacugccugacccgcuggaugcucaucgaggcggagcugaagugcuucggcaacacggccguggccaagugcaacgagaagcacgacgaggaguucugcgacaugcugcggcuguucgacuucaacaagcaggccauccagcgccugaaggccgaggcgcagaugagcauccagcugaucaacaaggccgucaacgcccucaucaacgaccagcugaucaugaagaaccaccuccgggacaucauggggauccccuacugcaacuacuccaaguacugguaccucaaccacaccaccaccggcaagacgagccugcccaagugcuggcugguguccaacggcagcuaccucaacgagacccacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaagcccugccccaagccccaccgccugaaccacaugggcaucugcuccugcgggcuguacaagcagccgggcguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5951 - RNA, 1658 nt, Artificial Sequence
  mRNA product Design3 comprising derived and/or modified sequence from Lassa virus__AIT17318__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgggggcaagaucagcguccaguacaaccugucccacagcuacgccguggacgcggccaaccacugcgggacgguggccaacggcguccuccagaccuucaugcggauggccuggggcggguccuacaucgcgcuggacagcggccgcgggaacugggacugcaucaugaccuccuaccaguaccugaucauccagaacaucaccugggaggaccacugccaguucagccggcccucccccaucggcuaccucgggcugcugagccagcgcacgcgggacaucuacaucucccgccggcuccugggcaccuucaccuggacccugagcgacagcgagggcaacgacacgcccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaaggcggaggcccagauguccauccagcucaucaacaaggccgugaacgcccugaucaacgaccagcugaucaugaagaaccaccuccgggacaucaugggcauccccuacugcaacuacagcaaguacugguaccugaaccacaccacgaccgggaagaccucccugcccaagugcuggcucgucagcaacggcuccuaccugaacgagacccacuucagcgacgacaucgagcagcaggccgacaacaugaucacggagaugcugcagaaggaguacauggagcgccagggcaagaccccgcucgggcugguggaccuguucguguucuccaccagcuucuaccugaucuccaucuuccuccaccuggucaagaucccgacccaccggcacaucgugggcaagcccugccccaagccccaccgccugaaccacauggggaucugcagcugcggccucuacaagcagccgggggugcccguccgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5952 - RNA, 1658 nt, Artificial Sequence
  mRNA product Design3 comprising derived and/or modified sequence from Lassa virus__AIT17322__GPC (opt1)
gggagaaagcuuaccaugggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaagggggccuacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacacccucaugagcaucaucuccacguuccaccugagcauccccaacuucaaccaguacgaggccauguccugcgacuucaacgggggcaagaucagcgugcaguacaaccugucccacagcuacgccgucgacgcggccaaccacugcgggaccguggccaacggcgugcuccagaccuucaugcggauggccuggggcggguccuacaucgcgcuggacagcggccgcgggaacugggacugcaucaugaccuccuaccaguaccugaucauccagaacacgaccugggaggaccacugccaguucagccggcccucccccaucggcuaccucgggcugcugagccagcgcacccgggacaucuacaucucccgccggcuccugggcaccuucacguggacccugagcgacagcgagggcaacgacacccccgggggcuacugccucacccgcuggaugcugaucgaggccgagcugaagugcuucgggaacacggccgucgccaagugcaacgagaagcacgacgaggaguucugcgacaugcuccggcuguucgacuucaacaagcaggccauccagcgccugaaggcggaggcccagauguccauccagcucaucaacaaggccgugaacgcccugaucaacgaccagcugaucaugaagaaccaccuccgggacaucaugggcauccccuacugcaacuacagcaaguacugguaccugaaccacaccaccaccgggaagacgucccugcccaagugcuggcucgugagcaacggcuccuaccugaacgagacccacuucagcgacgacaucgagcagcaggccgacaacaugaucaccgagaugcugcagaaggaguacauggagcgccagggcaagaccccgcucgggcuggucgaccuguucguguucuccacgagcuucuaccugaucuccaucuuccuccaccuggugaagaucccgacccaccggcacaucgucggcaagcccugccccaagccccaccgccugaaccacauggggaucugcagcugcggccucuacaagcagccgggggugcccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5953 - RNA, 1658 nt, Artificial Sequence
  mRNA product Design3 comprising derived and/or modified sequence from Lassa virus__AIT17328__GPC (opt1)
gggagaaagcuuaccaugggccagaucgugaccuucuuccaggaggucccccacgugaucgaggaggugaugaacaucguccugaucacccucagcauccuggccgugcugaaggggcucuacaacaucgccacgugcggccugguggggcuggucaccuuccuccugcugugcggcaaguccugcaccaccagccucuacaaggggguguacgagcugcagacgcuggagcucaacauggagacccugaacaugaccaugccgcuguccugcaccaagaacaacagccaccacuacauccgcgugggcaacgagacgggccucgagcugacccugaccaacaccuccaucaucaaccacaaguucugcaaccucagcgacgcgcacaagaagaaccuguacgaccacgcccugauguccaucaucagcacguuccaccucuccauccccaacuucaaccaguacgaggccaugagcugcgacuucaacgggggcaagaucuccguccaguacaaccugagccacuccuacgccguggacgccgcgaaccacugcgggaccguggccaacggcguccugcagaccuucaugcggauggccuggggcgggagcuacaucgcccucgacuccggccacgggaacugggacugcaucaugaccagcuaccaguaccugaucauccagaacacgaccugggaggaccacugccaguucucccgccccagccccaucggcuaccuggggcuccugucccagcggacccgcgacaucuacaucagccggcgccugcucggcaccuucacguggacccugagcgacuccgagggcaacgacgcgcccgggggcuacugccugacccgguggaugcucaucgaggccgagcugaagugcuucgggaacaccgccguggccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcuggucuccaacggcagcuaccucaacgagacgcacuucuccgacgacaucgagcagcaggccgacaacaugaucaccgagaugcugcagaaggaguacauggagcggcagggcaagaccccgcuggggcucguggaccuguucguguucagcaccuccuucuaccugaucagcaucuuccugcaccucgucaagaucccgacgcaccgccacguggugggcaaguccugccccaagccccaccggcugaaccacauggggaucugcagcugcggccuguacaagcagcccggggucccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5954 - RNA, 1658 nt, Artificial Sequence
  mRNA product Design3 comprising derived and/or modified sequence from Lassa virus__AIT17332__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacauccgggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccguggacgcggccaaccacugcgggacgguggccaacggcguccuccagaccuucaugcgcauggccuggggcgggagcuacaucgcgcuggacuccggccacgggcggugggacugcaucaugaccagcuaccaguaccugaucauccagaacaccacgugggaggaccacugccucuucucccgccccagccccaucggcuaccuggggcugcucucccagcggacccgcgacaucuacaucagccggcgccugcugggcaccuucaccuggacgcucagcgacuccgagggccgggacacccccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggccauccagcgccucaaggcggaggcccagaugagcauccagcugaucaacaaggccgugaacgcccugaucaacgaccagcucaucaugaagaaccaccuccgggacaucaugggcauccccuacugcaacuacuccaaguacugguaccugaaccacacgaccaccgggcgcaccagccugccccggugcuggcuggucuccaacggcagcuaccugaacgagacgcacuucuccgacgacaucgagcagcaggccgacaacaugaucaccgagaugcuccagaaggaguacauggagcgccagggcaagaccccgcuggggcugguggaccuguucguguucagcaccuccuucuaccucaucagcaucuuccugcaccuggucaagaucccgacgcaccggcacaucgugggcaaguccugccccaagccccaccgccucaaccacauggggaucugcagcugcggccuguacaagcagcccggggugccggucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5955 - RNA, 1658 nt, Artificial Sequence
  mRNA product Design3 comprising derived and/or modified sequence from Lassa virus__AIT17340__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaucuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcggcgagugggacugcaucaugaccagcuaccaguaccugaucauccagaacaccaccugggaggaccacugccaguucucccggcccagccccaucggguaccugggccuccugucccagcgcacgcgggacaucuacaucagccgccggcugcucggcaccuucaccuggacccugagcgacuccgaggggaaggacacgccgggcggguacugccugacccgcuggaugcucaucgaggccgagcugaagugcuucggcaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacaccacgaccggcaagaccagccugcccaagugcuggcugguguccaacggcagcuaccucaacgagacccacuucuccgacgacaucgagcagcaggccgacaacaugaucacggagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugcccccgcccccaccggcugaaccacaugggcaucugcuccugcgggcuguacaagcagccgggcgugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5956 - RNA, 1658 nt, Artificial Sequence
  mRNA product Design3 comprising derived and/or modified sequence from Lassa virus__AIT17344__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacaaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccagccacugcggcacgguggccaacggggugcugcagaccuucaugcggauggccuggggcggcuccuacaucgcgcucgacagcggguacggcaagugggacugcaucaugaccuccuaccaguaccugaucauccagaacaccacgugggaggaccacugccaguucagccgccccucccccaucggguaccugggccuccugagccagcggacccgcgacaucuacaucagccggcgccugcucggcaccuucaccuggacgcuguccgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaagacggaggcgcagauguccauccagcugaucaacaaggccgugaacgcccucaucaacgaccagcugaucaugaagaaccaccuccgcgacaucauggggauccccuacugcaacuacagcaaguacugguaccugaaccacaccaccaccggcaagacgucccugcccaagugcuggcuggugagcaacggcuccuaccucaacgagacccacuucagcgacgacaucgagcagcaggccgacaacaugaucaccgagaugcugcagaaggaguacauggagcggcaggggaagacgccccugggccucgucgaccuguucguguucuccaccagcuucuaccugaucuccaucuuccugcaccucgugaagaucccgacccaccgccacaucgucggcaagagcugccccaagccccaccggcugaaccacauggggaucugcuccugcgggcuguacaagcagcccggcgugccggugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5957 - RNA, 1658 nt, Artificial Sequence
  mRNA product Design3 comprising derived and/or modified sequence from Lassa virus__AIT17348__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaacgacaccccgggcggguacugccugacccgguggaugcucaucgaggccgagcugaagugcuucggcaacaccgccguggccaagugcaacgagaagcacgacgaggaguucugcgacaugcugcgccucuucgacuucaacaagcaggccauccagcggcugaaggcggaggcccagaugagcauccagcugaucaacaaggccgucaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucguggaccuguucgucuucagcaccuccuucuaccugaucagcaucuuccugcaccucgugaagaucccgacccaccgccacaucguggggaagcccugccccaagccccaccggcugaaccacaugggcaucugcuccugcgggcuguacaagcagccgggcguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5958 - RNA, 1658 nt, Artificial Sequence
  mRNA product Design3 comprising derived and/or modified sequence from Lassa virus__AIT17350__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacaucauggugggcaacgagaccggccucgagcugacgcugaccaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgggggacgccgccaagcacugcggcacgguggccaacggggugcugcagaccuucaugcggauggcguggggcggcuccuacaucgcccucgacagcgggcgcaacggcugggacugcgucaugaccuccuaccaguaccugaucauccagaacaccacgugggaggaccacugccaguucagccggcccucccccaucggguaccugggccuccugagccagcgcacccgggacaucuacaucucccgccggcugcucggcaccuucaccuggacgcugagcgacagcgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggcgauccagcgccugaagacggaggcccagauguccauccagcugaucaacaaggccgugaacgcccucaucaacgaccagcugaucaugaagaaccaccuccgggacaucauggggauccccuacugcaacuacagcaaguacugguaccucaaccacaccgucaccggcaagaccucccugccccgcugcuggcuggugagcaacggcuccuaccucaacgagacgcacuucagcgacgacaucgagcagcaggccgacaacaugaucaccgagaugcugcagaaggaguacaucgagcggcaggggaagacgccccugggccucguggaccuguucgucuucuccaccagcuucuaccugaucuccaucuuccugcaccucgugaagaucccgacccaccgccacaucaucgggaagcccugccccaagccccaccggcugaaccacaugggcaucugcagcugcgggcuguacaagcagccgggcgugcccguccgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5959 - RNA, 1658 nt, Artificial Sequence
  mRNA product Design3 comprising derived and/or modified sequence from Lassa virus__AIT17354__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaucuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcacggcgggugggacugcaucaugaccagcuaccaguaccugaucauccagaacaccaccugggaggaccacugccaguucucccgccccagccccaucggcuaccugggccuccugucccagcggacgcgcgacaucuacaucagccggcgccugcucgggaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacaccacgaccggcaagaccagccugcccaagugcuggcugguguccaacgggagcuaccucaacgagacccacuucuccgacgacaucgagcagcaggccgacaacaugaucacggagaugcugcagaaggaguacauggagcggcagggcaagaccccgcuggggcucgucgaccuguucguguucagcaccuccuucuaccugaucagcaucuuccugcaccucgugaagaucccgacccaccgccacaucgucggcaagcccugcccccggccccaccgccugaaccacauggggaucugcuccugcggccuguacaagcagccgggcgugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5960 - RNA, 1658 nt, Artificial Sequence
  mRNA product Design3 comprising derived and/or modified sequence from Lassa virus__AIT17360__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucaaccaccgcuucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggcaagugggacugcaucaugaccagcuaccaguaccugaucauccagaacaccacgugggacgaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccggcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccugaaccacacgaccaccggcaagaccagccugccccgcugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcggguucuacaagcagcccggcgugccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5961 - RNA, 1658 nt, Artificial Sequence
  mRNA product Design3 comprising derived and/or modified sequence from Lassa virus__AIT17364__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacaucgagcggcagggcaagaccccgcuggggcucgucgaccuguucguguucagcaccuccuucuaccugaucagcaucuuccugcaccucgugaagaucccgacgcaccgccacaucgucggcaagcccugccccaagccccaccggcugaaccacauggggaucugcuccugcggccuguacaagcagccgggggugagcgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5962 - RNA, 1658 nt, Artificial Sequence
  mRNA product Design3 comprising derived and/or modified sequence from Lassa virus__AIT17368__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguucgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacagcaagugggacugcaucaugaccuccuaccaguaccugaucauccagaacaccacgugggacgaccacugccaguucagccgccccucccccaucggcuaccuggggcuccugagccagcggacccgcgacaucuacaucagccggcgccugcucggcaccuucaccuggacgcuguccgacagcgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagauguccauccagcugaucaacaaggccgugaacgcccucaucaacgaccagcugaucaugaagaaccaccuccgcgacaucaugggcauccccuacugcaacuacagcaaguacugguaccugaaccacacgaccaccgggaagaccucccugcccaagugcuggcuggugagcaacggcuccuaccucaacgagacgcacuucagcgacgacaucgagcagcaggccgacaacaugaucaccgagaugcugcagaaggaguacauggagcggcagggcaagaccccgcuggggcucgucgaccuguucguguucuccaccagcuucuaccugaucuccaucuuccugcaccucgugaagaucccgacgcaccgccacaucgucggcaagagcugccccaagccccaccggcugaacuacauggggaucugcuccugcggcuucuacaagcagcccggggugccggugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5963 - RNA, 1658 nt, Artificial Sequence
  mRNA product Design3 comprising derived and/or modified sequence from Lassa virus__AIT17370__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaagcccugccccaagccccaccggcugaaccacauggggaucugcuccugcggccuguacaagcagccgggggugagcgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5964 - RNA, 1658 nt, Artificial Sequence
  mRNA product Design3 comprising derived and/or modified sequence from Lassa virus__AIT17378__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccguccaguacaaccugagccacuccuacgccguggacgccgcgaaccacugcgggaccguggccaacggcguccuccagaccuucaugcggauggccuggggcgggagcuacaucgcccuggacuccggccgcagcgggugggacugcaucaugaccuccuaccaguaccuggugauccagaacacgaccugggaggaccacugccaguucagccggcccucccccaucggcuaccucgggcugcugagccagcgcacccgggacaucuacaucagccgccggcuccugggcaccuucacguggacccuguccgacagcgagggcaagaacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagauguccauccagcucaucaacaaggccgucaacgcccugaucaacgaccagcugaucaugaagaaccaccuccgggacaucaugggcauccccuacugcaacuacagcaaguacugguaccugaaccacaccaccaccgggcgcacgucccugccccggugcuggcucgugagcaacggcuccuaccugaacgagacccacuucagcgacgacaucgagcagcaggccgacaacaugaucaccgagaugcugcagaaggaguacauggagcgccagggcaagaccccgcucgggcugguggaccuguucgucuucuccacgagcuucuaccugaucuccaucuuccuccaccuggugaagaucccgacccaccggcacaucgugggcaagagcugccccaagccccaccgccugaaccacauggggaucugcuccugcggcuucuacaagcagcccggggucccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5965 - RNA, 1658 nt, Artificial Sequence
  mRNA product Design3 comprising derived and/or modified sequence from Lassa virus__AIT17388__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaucaucagcguccaguacaaccugucccacagcuacgcgggggacgccgccaaccacugcggcacgguggccaacggggugcugcagaccuucaugcgcauggcguggggcggcuccuacaucgcccucgacagcgggcggaacggcugggacugcaucaugaccuccuaccaguaccugaucauccagaacaccacgugggacgaccacugccaguucagccgccccucccccaucggguaccugggccuccugagccagcggacccgcgacaucuacaucucccggcgccugcucggcaccuucaccuggacgcugagcgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggcgauccagcggcugaagacggaggcccagaugaacauccagcugaucaacaaggccgugaacgcccucaucaacgaccagcugaucaugaagaaccaccuccgcgacaucauggggauccccuacugcaacuacuccaaguacugguaccugaacaacaccgccaccggcaagaccagccugccccggugcuggcugguguccaacggcagcuaccucaacgagacgcacuucuccgacgacaucgagcagcaggcggacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugccccaagccccaccgccugaaccacaucggcaucugcuccugcgggcuguacaagcagccgggcgugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5966 - RNA, 1655 nt, Artificial Sequence
  mRNA product Design3 comprising derived and/or modified sequence from Lassa virus__AIT17404__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucaucaagaucccgacccaccgccacaucaccggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5967 - RNA, 1655 nt, Artificial Sequence
  mRNA product Design3 comprising derived and/or modified sequence from Lassa virus__AIT17408__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccgucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5968 - RNA, 1655 nt, Artificial Sequence
  mRNA product Design3 comprising derived and/or modified sequence from Lassa virus__AIT17412__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccuccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggcgaagugcaacgagaagcacgacgaggaguucugcgacaugcugcgccuguucgacuucaacaagcaggccauccggcgccucaagaccgaggcccagauguccauccagcugaucaacaaggccgugaacgcccugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggcggacaacaugaucaccgagcuccugcagaaggaguacaucgaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5969 - RNA, 1655 nt, Artificial Sequence
  mRNA product Design3 comprising derived and/or modified sequence from Lassa virus__AIT17416__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcgcauggccuggggcggguccuacaucgcccuggacagcggcaagggguccugggacugcaucaugacgagcuaccaguaccucaucauccagaacaccuccugggaggaccacugccaguucagccggcccagccccaucggcuaccuggggcugcucucccagcgcacccgggacaucuacaucagccgccggcugcugggcaccuucacguggacccucuccgacagcgagggcaacgagacccccgggggcuacugccugacccgcuggaugcugaucgaggccgagcucaagugcuucgggaacacggccguggcgaagugcaacgagaagcacgacgaggaguucugcgacaugcugcggcuguucgacuucaacaagcaggccauccgccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacaccgucaccgggaagacgucccugccccggugcuggcuggugagcaacggcuccuaccugaacgagacccacuucagcgacgacaucgagcagcaggcggacaacaugaucaccgagcuccugcagaaggaguacaucgaccgccagggcaagaccccgcuggggcucguggaccuguucgucuucuccacgagcuucuaccugaucuccaucuuccugcaccucgugaagaucccgacccaccggcacgugaucggcaagcccugccccaagccccaccgccugaaccacauggggaucugcagcugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5970 - RNA, 1655 nt, Artificial Sequence
  mRNA product Design3 comprising derived and/or modified sequence from Lassa virus__AIT17420__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucaucaagaucccgacccaccgccacaucacgggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5971 - RNA, 1655 nt, Artificial Sequence
  mRNA product Design3 comprising derived and/or modified sequence from Lassa virus__AIT17424__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacaaccacgcccugaugagcaucaucuccaccuuccaccugagcauccccaacuucaaccaguacgaggccauguccugcgacuucaacgggggcaagaucagcgugcaguacaaccucucccacgccuacgcgguggacgccgccaaccacugcgggaccaucgccaacggcguccugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagacgaacauccagcugaucaacaaggccgugaacgcccugaucaacgaccagcucaucaugaagaaccaccuccgggacaucaugggcauccccuacugcaacuacuccaaguacugguaccugaaccacaccgucaccgggaagaccagccugccccgcugcuggcugguguccaacggcagcuaccugaacgagacgcacuucuccgacgacaucgagcagcaggccgacaacaugaucaccgagcuccugcagaaggaguacauggaccggcagggcaagaccccgcuggggcucguggaccuguucgucuucagcaccuccuucuaccugaucagcaucuuccugcaccucgugaagaucccgacgcaccgccacaucaucggcaagcccugccccaagccccaccggcugaaccacauggggaucugcuccugcggccuguacaagcacccgggggugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5972 - RNA, 1655 nt, Artificial Sequence
  mRNA product Design3 comprising derived and/or modified sequence from Lassa virus__AIT17428__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgccgccgaccucaagugcuucgggaacaccgccguggcgaagugcaacgagaagcacgacgaggaguucugcgacaugcugcgccuguucgacuucaacaagcaggccaucgagcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggcggaccagccugccccgcugcuggcugguguccaacggcagcuaccugaacgagacccacuucuccgacgacaucgagcagcaggcggacaacaugaucacggagcuccugcagaaggaguacauggaccggcagggcaagaccccgcuggggcucguggaccuguucgucuucagcaccuccuucuaccugaucagcaucuuccugcaccucgugcgcaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5973 - RNA, 1655 nt, Artificial Sequence
  mRNA product Design3 comprising derived and/or modified sequence from Lassa virus__AIT17430__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggccggaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5974 - RNA, 1655 nt, Artificial Sequence
  mRNA product Design3 comprising derived and/or modified sequence from Lassa virus__AIT17438__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacauccgggucggcaacgagaccggccuggagcucacccugaccaacacgagcaucaucucccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaaggagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugaacauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggccgacaacaugaucacggagcuccugcagaaggaguacaucgaccgccagggcaagaccccgcuggggcucguggaccuguucgucuucuccaccagcuucuaccugaucuccaucuuccugcaccucgugaagaucccgacccaccggcacgugaucggcaagcccugccccaagccccaccgccugaaccagauggggaucugcagcugcggccuguacaagcagccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5975 - RNA, 1655 nt, Artificial Sequence
  mRNA product Design3 comprising derived and/or modified sequence from Lassa virus__AIT17442__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcgcauggccuggggcggguccuacaucgcccuggacagcggcaagggguccugggacugcaucaugacgagcuaccaguaccucaucauccagaacaccuccugggaggaccacugccaguucagccggcccagccccaucggcuaccuggggcugcucucccagcgcacccgggacaucuacaucagccgccggcugcugggcaccuucacguggacccucuccgacagcgagggcaacgagacccccgggggcuacugccugacccgcuggaugcugaucgaggccgagcucaagugcuucgggaacacggccguggcgaagugcaacgagaagcacgacgaggaguucugcgacaugcugcggcuguucgacuucaacaagcaggccauccgccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacaccgucaccgggaagacgucccugccccggugcuggcuggugagcaacggcuccuaccugaacgagacccacuucagcgacgacaucgagcagcaggcggacaacaugaucaccgagcuccugcagaaggaguacaucgaccgccagggcaagaccccgcuggggcucguggaccuguucgucuucuccacgagcuucuaccugaucuccaucuuccugcaccucgugaagaucccgacccaccggcacgugaucggcaagcccugccccaagccccaccgcaucaaccacauggggaucugcagcugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5976 - RNA, 1655 nt, Artificial Sequence
  mRNA product Design3 comprising derived and/or modified sequence from Lassa virus__AIT17446__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccucccacugcgggaccgucgccaacggcgugcugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccagccccaucggcuaccuggggcugcucucccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugccccgcugcuggcuggugagcaacggcuccuaccugaacgagacccacuucagcgacgacaucgagcagcaggccgacaacaugaucacggagcuccugcagaaggaguacauggaccggcagggcaagaccccgcuggggcucgucgaccuguucguguucuccaccagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5977 - RNA, 1655 nt, Artificial Sequence
  mRNA product Design3 comprising derived and/or modified sequence from Lassa virus__AIT17450__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacaucaucggcaagcccugccccaagccccaccggcugaaccacauggggaucugcuccugcggccuguacaagcacccgggggugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5978 - RNA, 1655 nt, Artificial Sequence
  mRNA product Design3 comprising derived and/or modified sequence from Lassa virus__AIT17454__GPC (opt1)
gggagaaagcuuaccaugggccagaucaucaccuucuuccaggaggugccccacgucaucgaggaggugaugaacaucgugcugaucgccuucagccuccuggccauccugaaggggaucuacaacgucgcgaccugcggccucuucgggcugguguccuuccugcuccugugcggccgcagcugcuccaccaccuacaaggggguguacgagcugcagacccucgagcuggacauggccagccugaacaugaccaugccgcucuccugcacgaagaacaacagccaccacuacaucauggucggcaacgagaccggccuggagcugacccucaccaacacguccaucaucaaccacaaguucugcaaccugagcgacgcccacaagcggaaccuguacgaccacgcccucauguccaucaucagcaccuuccaccuguccauccccaacuucaaccaguacgaggccaugagcugcgacuucaacgggggcaagaucuccgugcaguacaaccugagccacaccuacgcgguggacgccgccgggcacugcggcaccaucgccaacgggguccuccagacguucaugcgcauggcguggggcggcuccuacaucgcccuggacagcgggaagggcuccugggacugcaucaugaccagcuaccaguaccugaucauccagaacaccaccugggaggaccacugccaguucucccggcccagccccaucggguaccucggccugcugagccagcgcacgcgggacaucuacaucucccgccggcuccugggcaccuucaccuggacccugagcgacuccgaggggaacgagacgccgggcggguacugccucacccgcuggaugcugaucgaggccgagcugaagugcuucggcaacaccgccguggccaagugcaacgagaagcacgacgaggaguucugcgacaugcuccggcuguucgacuucaacaagcaggcgauccgccggcugaagaccgaggcccagaugagcauccagcucaucaacaaggccgugaacgcccugaucaacgaccagcugaucaugaagaaccaccuccgcgacaucauggggauccccuacugcaacuacuccaaguacugguaccugaaccacacgaucaccggcaagaccagccugccccggugcuggcucgucuccaacggcagcuaccugaacgagacccacuucuccgacgacaucgagcagcaggccgacaacaugaucacggagcugcuccagaaggaguacauggaccgccaggggaagacgccccugggccugguggaccucuucguguucagcaccuccuucuaccugaucagcaucuuccugcaccuggucaagaucccgacccaccggcacaucaucgggaagcccugccccaagccccaccgccucaaccacaugggcaucugcuccugcgggcuguacaagcacccgggcgugcccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5979 - RNA, 1655 nt, Artificial Sequence
  mRNA product Design3 comprising derived and/or modified sequence from Lassa virus__AIT17458__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggcaagggguccugggacugcaucaugaccaccuaccaguaccucaucauccagaacaccacgugggaggaccacugccaguucagccgccccucccccaucggcuaccuggggcugcucagccagcggacccgcgacaucuacaucagccggcgccugcugggcaccuucaccuggacgcucuccgacagcgagggcaacgagacccccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagacggaggcccagauguccauccagcugaucaacaaggccgugaacgcccugaucaacgaccagcucaucaugaagaaccaccuccgggacaucaugggcauccccuacugcaacuacagcaaguacugguaccugaaccacaccgugaccgggaagaccucccugccccgcugcuggcuggucagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucguguucuccaccagcuucuaccugaucuccaucuuccugcaccucgucaagaucccgacgcaccgccacgugaucggcaagcccugccccaagccccaccggcugaaccacauggggaucugcagcugcggccuguacaagcacccgggggugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5980 - RNA, 1655 nt, Artificial Sequence
  mRNA product Design3 comprising derived and/or modified sequence from Lassa virus__AIT17462__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugcccaagugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5981 - RNA, 1655 nt, Artificial Sequence
  mRNA product Design3 comprising derived and/or modified sequence from Lassa virus__AIT17466__GPC (opt1)
gggagaaagcuuaccaugggccagaucaucaccuucuuccaggaggugccccaggucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaaccaguccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuucgcgguggacgccgccaaccacugcgggaccaucgccaacggcguccugcagaccuucaugcggauggcguggggcggguccuacaucgcccuggacagcggccgcggguccugggacugcaucaugacgagcuaccaguaccucaucauccagaacaccaccugggaggaccacugccaguucucccggcccagccccaucggcuaccuggggcugcucagccagcgcacccgggacaucuacaucucccgccggcugcugggcacguucaccuggacccucagcgacuccgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccaucacggggaagaccagccugccccggugcuggcuggucuccaacggcagcuaccugaacgagacccacuucuccgacgacaucgagcagcaggccgacaacaugaucaccgagcuccugcagaaggaguacauggaccgccagggcaagacgccccuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5982 - RNA, 1655 nt, Artificial Sequence
  mRNA product Design3 comprising derived and/or modified sequence from Lassa virus__AIT17470__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5983 - RNA, 1655 nt, Artificial Sequence
  mRNA product Design3 comprising derived and/or modified sequence from Lassa virus__AIT17474__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccauccaguacaaccucagccacaccuacgcgguggacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacgaucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacaucacgggcaagcccugccccaagccccaccggcugaaccacauggggaucugcuccugcggccuguacaagcacccggggguccccgugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5984 - RNA, 1655 nt, Artificial Sequence
  mRNA product Design3 comprising derived and/or modified sequence from Lassa virus__AIT17478__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccgaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucagccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggccgacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacgugaucggcaagcccugccccaagccccaccgccucaaccacauggggaucugcagcugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5985 - RNA, 1655 nt, Artificial Sequence
  mRNA product Design3 comprising derived and/or modified sequence from Lassa virus__AIT17482__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaucaccugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggccgagcucaagugcuucgggaacacggccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgucaccgggaagacgagccugccccgcugcuggcugguguccaacggcagcuaccugaacgagacccacuucuccgacgacaucgagcagcaggcggacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacguggucggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5986 - RNA, 1655 nt, Artificial Sequence
  mRNA product Design3 comprising derived and/or modified sequence from Lassa virus__AIT17486__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccgugggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5987 - RNA, 1655 nt, Artificial Sequence
  mRNA product Design3 comprising derived and/or modified sequence from Lassa virus__AIT17490__GPC (opt1)
gggagaaagcuuaccaugggccagaucaucaccuucuuccaggaggugccccacgucaucgaggaggugaugaacaucgugcugaucacccucagccugcuggccauccucaaggggaucuacaacgucgccacgugcggccuguucgggcugguguccuuccuccugcugugcggccgcagcugcuccaccaccuacaaggggguguacgagcuccagacccuggagcuggacauggcgaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuucgccguggacgcggccaaccacugcgggacgaucgccaacggcguccugcagaccuucaugcggauggccuggggcgggagcuacaucgcgcuggacuccggcaaggggagcugggacugcaucaugaccuccuaccaguaccucaucauccagaacaccacgugggaggaccacugccaguucagccgccccucccccaucggcuaccuggggcugcucagccagcggacccgcgacaucuacaucagccggcgccugcugggcaccuucaccuggacgcucuccgacagcgagggcaacgagacccccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagacggaggcgcagauguccauccagcugaucaacaaggccgugaacgcccugaucaacgaccagcucaucaugaagaaccaccuccgggacaucaugggcauccccuacugcaacuacagcaaguacugguaccugaaccacaccgucaccgggaagaccucccugccccgcugcuggcuggugagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucgucuucuccaccagcuucuaccugaucuccaucuuccugcaccucgugaagaucccgacgcaccgccacaucaucggcaagcccugccccaagccccaccggcugaaccacauggggaucugcagcugcggccuguacaagcacccgggggugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5988 - RNA, 1655 nt, Artificial Sequence
  mRNA product Design3 comprising derived and/or modified sequence from Lassa virus__AIT17494__GPC (opt1)
gggagaaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaucuacaagggggucuacgagcuccagacccuggagcuggacauggccagccucaacaugaccaugccgcuguccugcaccaagaacaacagccaccacuacaucauggugggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagaccuucaugcggauggcguggggcggguccuacaucgcccuggacagcggcaagggguccugggacugcaucaugacgagcuaccaguaccucaucauccagaacaccuccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacaccgugaccgggaagacgucccugccccgcugcuggcuggugagcaacggcuccuaccugaacgagacccacuucagcgacgacaucgagcagcaggccgacaacaugaucaccgagcuccugcagaaggaguacaucgaccggcagggcaagaccccgcuggggcucgucgaccuguucguguucuccacgagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5989 - RNA, 1655 nt, Artificial Sequence
  mRNA product Design3 comprising derived and/or modified sequence from Lassa virus__AIT17498__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgagaccgagcucaagugcuucgggaacaccgccguggccaagugcaacgagaagcacgacgaggaguucugcgacaugcugcgccuguucgacuucaacaagcaggccaucucccggcuccgcagcgaggcgcagauguccauccagcugaucaacaaggccgugaacgcccugaucaacgaccagcucaucaugaagaaccaccuccgggacaucaugggcauccccuacugcaacuacagcaaguacugguaccugaaccacacggucaccgggaagaccucccugcccaagugcuggcuggugagcaacggcuccuaccugaacgagacccacuucagcgacgacaucgagcagcaggccgacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacaucacgggcaagcccugccccaagccccaccgccucaaccacauggggaucugcagcugcggccuguacaagcacccgggggugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5990 - RNA, 1655 nt, Artificial Sequence
  mRNA product Design3 comprising derived and/or modified sequence from Lassa virus__AIT17502__GPC (opt1)
gggagaaagcuuaccaugggccagaucaucaccuucuuccaggagaucccccacgugaucgaggaggucaugaacaucgugcugaucacccucagccugcuggccauccucaaggggaucuacaacguggccacgugcggccuguucgggcuggucuccuuccuccugcugugcggcaagagcugcuccaccaccuacaaggggguguacgagcuccagacccuggagcuggacauggcgagccucaacaugacgaugccgcuguccugcaccaagaacaacagccaccacuacaucauggugggcaacgagaccggccuggagcucacccugacgaacaccuccaucaucaaccacaaguucugcaaccugagcgacgcccaccgcaagaaccucuacgaccacacccugauguccaucaucagcaccuuccaccuguccauccccaacuucaaccaguacgaggccaugagcugcgacuucaacgggggcaagaucuccguccaguacaaccucagccacgccuacgccaucgacgcggccacgcacugcgggaccaucgccaacggcgugcugcagaccuucaugcggauggccuggggcggguccuacaucgcgcuggacagcggcaagggcgggugggacugcaucaugaccuccuaccaguaccucaucauccagaacacgaccugggaggaccacugccaguucagccgccccucccccaucggguaccugggccugcucagccagcggacccgcgacaucuacaucagccggcgccugcugggcaccuucacguggacccucuccgacagcgaggggaacgagaccccgggcggguacugccugacccgguggaugcugaucgaggccgagcucaagugcuucggcaacacggccguggccaagugcaacgagaagcacgacgaggaguucugcgacaugcugcgccuguucgacuucaacaagcaggccauccggcgccucaagaccgaggcgcagauguccauccagcugaucaacaaggccgucaacgcccugaucaacgaccagcucaucaugcggaaccaccuccgcgacaucauggggauccccuacugcaacuacagcaaguacugguaccugaaccacaccgugaccggcaagacgucccugcccaagugcuggcuggugagcaacggcuccuaccugaacgagacccacuucagcgacgacaucgagcagcaggccgacaacaugaucaccgagcuccugcagaaggaguacauggaccggcaggggaagacgccccugggccucgucgaccuguucguguucuccaccagcuucuaccugaucuccaucuuccugcaccucgugaagaucccgacccaccgccacgucaucgggaagcccugccccaagccccaccggcugaaccacaugggcgugugcagcugcgggcuguacaagcacccgggcgugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5991 - RNA, 1655 nt, Artificial Sequence
  mRNA product Design3 comprising derived and/or modified sequence from Lassa virus__AIT17506__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccgagcacugcgggaccaucgcgaacggcguccugcagaccuucaugcggauggccuggggcggguccuacaucgcccuggacagcggcaagggguccugggacugcgugaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccaucgagcggcucaagaccgaggcccagaugagcauccagcugaucaacaaggccgucaacgcccugaucaacgaccagcucaucaugaagaaccaccuccgcgacaucaugggcaucccguacugcaacuacuccaaguacugguaccugaaccacaccgugacggggaagaccagccugccccggugcuggcugguguccaacggcagcuaccugaacgagacccacuucuccgacgacaucgagcagcaggcggacaacaugaucaccgagaugcuccagaaggaguacaucgaccgccagggcaagacgccccuggggcuggucgaccucuucguguucagcaccuccuucuaccugaucagcaucuuccugcaccuggugaagaucccgacccaccggcacgucaucggcaagcccugccccaagccccaccgccucaaccacauggggaucugcuccugcggccuguacaagcacccgggggugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5992 - RNA, 1655 nt, Artificial Sequence
  mRNA product Design3 comprising derived and/or modified sequence from Lassa virus__AIT17510__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgaaggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5993 - RNA, 1655 nt, Artificial Sequence
  mRNA product Design3 comprising derived and/or modified sequence from Lassa virus__AIT17514__GPC (opt1)
gggagaaagcuuaccaugggccagaucaucaccuucuuccaggaggugccccacgucaucgaggaggugaugaacaucgugcugaucgcccucagccugcuggccguccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguaccgccacccgggggugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5994 - RNA, 1655 nt, Artificial Sequence
  mRNA product Design3 comprising derived and/or modified sequence from Lassa virus__AIT17518__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5995 - RNA, 1655 nt, Artificial Sequence
  mRNA product Design3 comprising derived and/or modified sequence from Lassa virus__AIT17524__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggugaccgggaagaccagccugccccgcugcuggcuggucuccaacggcagcuaccugaacgagacccacuucuccgacgacaucgagcagcaggccgacaacaugaucacggagaugcuccagaaggaguacauggaccggcagggcaagaccccgcuggggcugguggaccucuucguguucagcaccuccuucuaccugaucagcaucuuccugcaccuggucaagaucccgacccaccgccacgugaucggcaagcccugccccaagccccaccggcucaaccacauggggaucugcuccugcggccuguacaagcacccgggggugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5996 - RNA, 1655 nt, Artificial Sequence
  mRNA product Design3 comprising derived and/or modified sequence from Lassa virus__AIT17528__GPC (opt1)
gggagaaagcuuaccaugggccagaucaucaccuucuuccaggaggugccccacgucaucgaggaggugaugaacaucgugcugaucgcccucagccugcuggccaugcucaaggggaucuacaacaucgcgaccugcggccuguucgggcugaucuccuuccuccugcugugcggccgcagcugcuccacgaccuacaagggggucuacgagcuccaggcccuggagcuggacauggccaaccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggcgauguccugcgacuucaacgggggcaagaucagcgugcaguacaaccucucccacaccuacgccggggacgccgccaagcacugcggcaccaucgcgaacgggguccugcagaccuucaugcggauggccuggggcggcagcuacaucgcccuggacuccgggaagggcaacugggacugcaucaugacgagcuaccaguaccucaucauccagaacaccaccugggaggaccacugccaguucucccgccccagccccaucggguaccugggccugcucucccagcggacccgcgacaucuacaucagccggcgccugcugggcacguucaccuggacccucagcgacuccgaggggaacgagaccccgggcggguacugccugacgcgguggaugcugaucgaggccgagcucaagugcuucggcaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucauggggauccccuacugcaacuacuccaaguacugguaccugaaccacagcgucaccggccgcacgucccugccccggugcuggcuggugagcaacggcuccuaccugaacgagacccaguucagcgacgacaucgagcagcaggcggacaacaugaucaccgagaugcuccagaaggaguacaucgaccgccaggggaagacgccccugggccugguggaccucuucgucuucuccaccagcuucuaccugaucuccaucuuccugcaccugaucaagaucccgacccaccggcacaucguggggaagcccugccccaagccccaccgccucaaccacaugggcaucugcagcugcgggcuguacaagcacccgggcauccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5997 - RNA, 1655 nt, Artificial Sequence
  mRNA product Design3 comprising derived and/or modified sequence from Lassa virus__AIT17538__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacaucgcgaccugcggccuguucgggcugaucuccuuccuccugcugugcggccgcagcugcuccacgaccuacaagggggucuacgagcuccagacccuggagcuggacauggccaaccucaacaugaccaugccgcugagcugcacgaagaacaacucccaccacuacaucauggugggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgaggggaagaucagcgugcaguacaaccucucccacagcuacgcgaucgacgccgccggccacugcgggaccaucgccaacggcguccugcagaccuucaugcggauggcguggggcggguccuacaucgcccuggacagcggcaaggggaacugggacugcaucaugacguccuaccaguaccucaucauccagaacaccaccugggaggaccacugccaguucagccgccccucccccaucggcuaccuggggcugcucagccagcggacccgcgacaucuacaucagccggcgccugcugggcacguucaccuggacccucuccgacagcgagggcaacgaggcccccgggggcuacugccugacccgguggaugcugaucgaggccgagcucaagugcuucgggaacacggccaucgcgaagugcaacgagaagcacgacgaggaguucugcgacaugcugcgccuguucgacuucaacaagcaggccaucaagcggcucaaggccgaggcccagauguccauccaccugaucaacaaggccgugaacgcgcugaucaacgaccagcucaucaugaagaaccaccuccgcgacaucaugggcauccccuacugcaacuacagcaaguacugguaccugaaccacaccgugaccgggaagaccucccugcccaagugcuggcuggucagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucguguucuccaccagcuucuaccugaucuccaucuuccugcaccucgucaagaucccgacgcaccgccacaucgugggccggcccugccccaagccccaccgccugaaccacauggggaucugcagcugcggccuguacaagcacccgggggugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5998 - RNA, 1655 nt, Artificial Sequence
  mRNA product Design3 comprising derived and/or modified sequence from Lassa virus__AIT17540__GPC (opt1)
gggagaaagcuuaccaugggccagaucgugaccuucuuccaggaggucccccacgugaucgaggagaucaugaacaucgugcugaucacccucagccugcuggccauccucaaggggaucuacaacuucgccacgugcggccugaucgggcugaucaccuuccucuuccugugcggccgcuccugcagcaccaucuacaagggguccuaccagcugcagacccucgagcugaacauggagacgcugaacaugaccaugccgcucagcugcaccaagaacaacucccaccacuacauccgggucggcaacgagaccggccuggagcugacgcucaccaacaccagcaucaucaaccacaaguucugcaaccuguccgaggcgcacaagaagaaccuguacgaccacgcccucaugagcaucaucuccaccuuccaccugagcauccccaacuucaaccaguacgaggccauguccugcgacuucaacgggggcaagaucagcgugcaguacaaccugucccacagcuacgccguggacgccgcgaaccacugcgggacggucgccaacggcgugcuccagaccuucaugcgcauggccuggggcggguccuacaucgcccuggacagcggccgggggaacugggacugcaucaugaccuccuaccaguaccugaucauccagaacaccacgugggaggaccacugccaguucagccgccccucccccaucggcuaccucgggcugcugagccagcggacccgcgacaucuacaucagccggcgccuccugggcaccuucaccuggacgcuguccgacagcgagggcaaggagacccccgggggcuacugccucacccgguggaugcugaucgaggcggagcugaagugcuucgggaacaccgccguggccaagugcaacgagaagcacgacgaggaguucugcgacaugcuccgccuguucgacuucaacaagcaggccauccagcggcugaagacggaggcccagauguccauccagcucaucaacaaggcggucaacgcccugaucaacgaccagcugaucaugaagaaccaccuccgcgacaucaugggcauccccuacugcaacuacagcaaguacugguaccugaaccacaccuccaccgggcggaccagccugcccaagugcuggcucguguccaacggcagcuaccugaacgagacgcacuucuccgacgacaucgagcagcaggccgacaacaugaucaccgagaugcugcagaaggaguacaucgaccgccagggcaagaccccgcucgggcugguggaccuguucgucuucagcaccuccuucuaccucaucagcaucuuccugcaccuggugaagaucccgacgcaccggcacaucgugggcaaguccugccccaagccccaccgccugaaccacauggggaucugcagcugcggccucuacaagcagcccggggucccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 5999 - RNA, 1655 nt, Artificial Sequence
  mRNA product Design3 comprising derived and/or modified sequence from Lassa virus__AIT17544__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugggcagccucaacaugaccaugccgcuguccugcacgaagaacaacagccaccacuacaucauggucggcaacgagaccgggcuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacggcgggaagaucuccgugcaguacaaccucagccacuccuacgccguggacgcggccaaccacugcggcaccaucgccaacgggguccugcagaccuucaugcggauggccuggggcggcagcuacaucgcgcuggacuccgggaagggcagcugggacugcaucaugacguccuaccaguaccucaucauccagaacaccaccugggaggaccacugccaguucagccgccccagccccaucggguaccugggccugcucucccagcggacccgcgacaucuacaucagccggcgccugcugggcacguucaccuggacccucuccgacagcgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggccauccggcgccucaagaccgaggcgcagauguccauccagcugaucaacaaggccgugaacgcccugaucaacgaccagcucaucaugaagaaccaccuccgggacaucauggggauccccuacugcaacuacagcaaguacugguaccugaaccacaccgucacgggcaagaccucccugccccgcugcuggcuggugagcaacggcuccuaccugaacgagacccacuucagcgacgacaucgagcagcaggccgacaacaugaucaccgagcuccugcagaaggaguacauggaccggcaggggaagacgccccugggccucguggaccuguucgucuucuccaccagcuucuaccugaucuccaucuuccugcaccucgugaagaucccgacccaccgccacaucaucgggaagcccugccccaagccccaccggcugaaccacaugggcaucugcagcugcgggcuguacaagcacccgggcgugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6000 - RNA, 1655 nt, Artificial Sequence
  mRNA product Design3 comprising derived and/or modified sequence from Lassa virus__AIT17548__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccucuuccugugcggccgcagcugcuccacgaccuacaaggggguguacgagcugcagacccucgagcuggacauggccagccugaacaugaccaugccgcucuccugcacgaagaacaacagccaccacuacaucauggucggcaacgagaccggccuggagcugacccucaccaacacguccaucaucaaccacaaguucugcaaccugagcgacgcccacaagcggaaccuguacgaccacgcccucauguccaucaucagcaccuuccaccuguccauccccaacuucaaccaguacgaggccaugagcugcgacuucaacgggggcaagaucuccgugcaguacaaccugagccacgcguacgccggggacgccgccaagcacugcggcaccaucgcgaacggggugcuccagaccuucaugcgcauggccuggggcggcuccuacaucgcccuggacagcgggaagggcuccugggacugcaucaugacgagcuaccaguaccugaucauccagaacaccaccugggaggaccacugccaguucucccggcccagccccaucggguaccucggccugcugagccagcgcacccgggacaucuacaucucccgccggcuccugggcacguucaccuggacccugagcgacuccgaggggaacgagaccccgggcggguacugccucacgcgcuggaugcugaucgaggccgagcugaagugcuucggcaacaccgccgucgcgaagugcaacgagaagcacgacgaggaguucugcgacaugcuccggcuguucgacuucaacaagcaggccauccgccggcugcgcaccgaggcccagaugagcauccagcucaucaacaaggccgugaacgcccugaucaacgaccagcugaucaugaagaaccaccuccgggacaucauggggauccccuacugcaacuacuccaaguacugguaccugaaccacaccgugacgggcaagaccagccugcccaagugcuggcucgucuccaacggcagcuaccugaacgagacccacuucuccgacgacaucgagcagcaggcggacaacaugaucaccgagaugcugcagaaggaguacaucgaccgccaggggaagacgccccucggccugguggaccuguucguguucagcaccuccuucuaccucaucagcaucuuccugcaccuggucaagaucccgacccaccggcacgugaucgggaagcccugccccaagccccaccgccugaaccacaugggcaucugcuccugcgggcucuacaagcacccgggcgugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6001 - RNA, 1655 nt, Artificial Sequence
  mRNA product Design3 comprising derived and/or modified sequence from Lassa virus__AIT17552__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccgugaacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagaagugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6002 - RNA, 1655 nt, Artificial Sequence
  mRNA product Design3 comprising derived and/or modified sequence from Lassa virus__AIT17556__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggccgcggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacgaucaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacaucacgggcaagcccugccccaagccccaccgccugaaccacauggggaucugcuccugcggccuguacaagcacccgggggugcccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6003 - RNA, 1655 nt, Artificial Sequence
  mRNA product Design3 comprising derived and/or modified sequence from Lassa virus__AIT17560__GPC (opt1)
gggagaaagcuuaccaugggccagaucaucaccuucuuccaggaggugccccacgucaucgaggaggugaugaacaucgugcugaucgcccucagccugcuggccguccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaccaacaacagccaccacuacaucauggugggcaacgagaccggccuggagcucacccugacgaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccggggaggccgccaaccacugcggcaccaucgcgaacgggguccugcagacguucaugcggauggccuggggcggcuccuacaucgcccuggacagcgggaagggcuccugggacugcaucaugaccagcuacaaguaccucaucauccagaacaccaccuggggcgaccacugccaguucucccgccccagccccaucggguaccugggccugcucagccagcggacgcgcgacaucuacaucucccggcgccugcuggggaccuucaccuggacccucagcgacuccgagggcaacgagacgcccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccauccggaagcucaagaccgaggcccagaugagcauccagcugaucaacaaggccgugaacgcccugaucaacgaccagcucaucaugaagaaccaccuccgcgacaucaugggcauccccuacugcaacuacucccgguacugguaccugaaccacacggucaccggccgcaccagccugccccggugcuggcugguguccaacgggagcuaccugaacgagacccacuucuccgacgacaucgagcagcaggcggacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggcgugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6004 - RNA, 1655 nt, Artificial Sequence
  mRNA product Design3 comprising derived and/or modified sequence from Lassa virus__AIT17564__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugcucuccuuccugcugcucugcggccgcagcugcuccacgaccuacaaggggguguacgagcugcagacccuggagcucgacauggccagccugaacaugaccaugccgcuguccugcacgaagaacaacagccaccacuacaucauggugggcaacgagaccggccucgagcugacccugaccaacacguccaucaucaaccacaaguucugcaaccucagcgacgcccacaagaaggaccuguacgaccacgcccugauguccaucaucagcaccuuccaccucuccauccccaacuucaaccaguacgaggccaugagcugcgacuucaacgggggcaagaucuccguccaguacaaccugagccacgcguacgccguggacgccgccaagcacugcgggaccaucgcgaacggcgugcugcagaccuucaugcggauggccuggggcggguccuacaucgcccucgacagcggcaagggguccugggacugcaucaugacgagcuaccaguaccugaucauccagaacaccuccugggaggaccacugccaguucagccgccccagccccaucggcuaccuggggcuccugucccagcggacccgcgacaucuacaucagccggcgccugcucggcaccuucacguggacccuguccgacagcgagggcaacgagacccccgggggcuacugccugacccgguggaugcucaucgaggccgagcugaagugcuucgggaacacggccgucgcgaagugcaacgagaagcacgacgaggaguucugcgacaugcugcgccucuucgacuucaacaagcaggccaucaagcggcugaagaccgaggcccagauguccauccagcugaucaacaaggccgugaacgcccucaucaacgaccagcugaucaugaagaaccaccuccgcgacaucaugggcauccccuacugcaacuacagcaaguacugguaccugaaccacaccgugaccgggaagacgucccugccccggugcuggcuggucagcaacggcuccuaccucaacgagacccacuucagcgacgacaucgagcagcaggcggacaacaugaucaccgagcugcugcagaaggaguacaucgaccgccagggcaagaccccgcucgggcugguggaccuguucguguucuccacgagcuucuaccugaucuccaucuuccuccaccuggucaagaucccgacccaccggcacgugaucggcaagcccugccccaagccccaccgccugaaccacauggggaucugcagcugcggccucuacaagcacccgggggugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6005 - RNA, 1655 nt, Artificial Sequence
  mRNA product Design3 comprising derived and/or modified sequence from Lassa virus__AIT17572__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaacuacgcgguggacgccgccaaccacugcgggaccaucgccaacggcguccugcagaccuucaugcggauggcguggggcgggagcuacaucgcccuggacuccggcaaggggaacugggacugcaucaugacgagcuaccaguaccucaucauccagaacaccaccugggaggaccacugccaguucucccgccccagccccaucggcuaccuggggcugcucucccagcggacccgcgacaucuacaucagccggcgccugcugggcacguucaccuggacccucagcgacuccgagggcaacgacaugcccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagaugaacauccagcugaucaacaaggccgugaacgcccugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacaucaucggcaagcccugccccaagccccaccggcugaaccacauggggaucugcagcugcggccuguacaagcacccgggggugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6006 - RNA, 1655 nt, Artificial Sequence
  mRNA product Design3 comprising derived and/or modified sequence from Lassa virus__AIT17576__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucucccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagaugcuccagaaggaguacaucgaccgccagggcaagaccccgcuggggcugguggaccucuucgucuucagcaccuccuucuaccugaucagcaucuuccugcaccuggugaagaucccgacccaccggcacaucacgggcaagcccugccccaagccccaccgccucaaccacauggggaucugcuccugcggccuguacaagcacccgggggugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6007 - RNA, 1655 nt, Artificial Sequence
  mRNA product Design3 comprising derived and/or modified sequence from Lassa virus__AIT17580__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagagcaacgagacgccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggcgauccggcgccucaaggccgaggcccagauguccauccagcugaucaacaaggccgugaacgcccugaucaacgaccagcucaucaugaagaaccaccuccgggacaucauggggauccccuacugcaacuacagcaaguacugguaccugaaccacaccgucacgggccgcaccucccugccccggugcuggcuggugagcaacggguccuaccugaacgagacccacuucagcgacgacaucgagcagcaggcggacaacaugaucaccgagcuccugcagaaggaguacauggaccgccagggcaagacgccccugggccucguggaccuguucgucuucuccaccagcuucuaccugaucuccaucuuccugcaccucgugaagaucccgacccaccggcacgugaucgggaagcccugccccaagccccaccgccugaaccacaugggcaucugcagcugcgggcuguacaagcacccgggcguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6008 - RNA, 1655 nt, Artificial Sequence
  mRNA product Design3 comprising derived and/or modified sequence from Lassa virus__AIT17584__GPC (opt1)
gggagaaagcuuaccaugggccagaucaucaccuucuuccaggaggugccccaggucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaaccaguccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacuccuucgcgguggacgccgccaaccacugcgggaccaucgccaacggcguccugcagaccuucaugcggauggcguggggcgggagcuacaucgcccuggacuccggcaaggggagcugggacugcaucaugaccuccuaccaguaccucaucauccagaacacgaccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucaugggcauccccuacugcaacuacagcaaguacugguaccugaaccacaccaagaccgggaagacgucccugccccgcugcuggcuggucagcaacggcuccuaccugaacgagacccacuucagcgacgacaucgagcagcaggccgacaacaugaucaccgagcuccugcagaaggaguacauggaccggcagggcaagaccccgcuggggcucguggaccuguucguguucuccacgagcuucuaccugaucuccaucuuccugcaccucgucaagaucccgacccaccgccacgugaucggcaagcccugccccaagccccaccggcugaaccacauggggaucugcagcugcggccuguacaagcacccgggggugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6009 - RNA, 1655 nt, Artificial Sequence
  mRNA product Design3 comprising derived and/or modified sequence from Lassa virus__AIT17588__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaaggccgaggcccagaugagcauccagcugaucaacaaggccgugaacgcgcugaucaacgaccagcucaucaugaagaaccaccuccgggacaucaugggcauccccuacugcaacuacuccaaguacugguaccugaaccacaccgucaccgggaagacgagccugccccgcugcuggcugguguccaacggcagcuaccugaacgagacccacuucuccgacgacaucgagcagcaggccgacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6010 - RNA, 1655 nt, Artificial Sequence
  mRNA product Design3 comprising derived and/or modified sequence from Lassa virus__AIT17592__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacacccugauguccaucaucagcaccuuccaccuguccauccccaacuucaaccaguacgaggccaugagcugcgacuucaacgggggccggaucuccgugcaguacaaccucagccacgccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacgaucaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacguggugggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6011 - RNA, 1655 nt, Artificial Sequence
  mRNA product Design3 comprising derived and/or modified sequence from Lassa virus__AIT17596__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccuccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucaugggcaucccguacugcaacuacagcaaguacugguaccugaaccacaccgucacggggaagaccucccugccccgcugcuggcuggugagcaacggcuccuaccugaacgagacccacuucagcgacgacaucgagcagcaggccgacaacaugaucaccgagcuccugcagaaggaguacaucgaccggcagggcaagacgccccuggggcucguggaccuguucgucuucuccaccagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6012 - RNA, 1655 nt, Artificial Sequence
  mRNA product Design3 comprising derived and/or modified sequence from Lassa virus__AIT17600__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccggggacgccgccaaccacugcggcaccaucgcgaacggggugcugcagaccuucaugcggauggccuggggcggcuccuacaucgcccuggacagcgggaagggcuccugggacugcaucaugacgagcuaccaguaccucaucauccagaacaccaccugggaggaccacugccaguucucccgccccagccccaucggguaccugggccugcucagccagcggacccgcgacaucuacaucucccggcgccugcugggcacguucaccuggacccucagcgacuccgaggggaacgagaccccgggcggguacugccugacgcgguggaugcugaucgaggccgagcucaagugcuucggcaacaccgccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucauggggauccccuacugcaacuacuccaaguacugguaccugaaccacaccgugacgggcaagaccagccugccccgcugcuggcuggucuccaacggcagcuaccugaacgagacccacuucuccgacgacaucgagcagcaggcggacaacaugaucaccgagcuccugcagaaggaguacaucgaccggcaggggaagacgccccugggccucguggaccuguucguguucagcaccuccuucuaccugaucagcaucuuccugcaccucgucaagaucccgacccaccgccacgugaucgggaagcccugccccaagccccaccggcugaaccacaugggcaucugcuccugcgggcuguacaagcacccgggcgugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6013 - RNA, 1655 nt, Artificial Sequence
  mRNA product Design3 comprising derived and/or modified sequence from Lassa virus__AIT17604__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccagccucaacaugacgaugccgcuguccugcaccaagaacaacagccaccacuacaucauggucggcaacgagaccggccuggagcucacccugacgaacaccuccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgccguggacgcggccaagcacugcgggacgaucgccaacggcguccugcagaccuucaugcggauggccuggggcggguccuacaucgcgcuggacagcggcaagggguccugggacugcaucaugaccagcuaccaguaccucaucauccagaacaccacgugggaggaccacugccaguucucccgccccagccccgugggcuaccuggggcugcucagccagcggacccgcgacaucuacaucucccggcgccugcugggcaccuucaccuggacgcucagcgacuccgagggcaacgagacccccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagacggaggcgcagaugagcauccagcugaucaacaaggccgucaacgcccugaucaacgaccagcucaucaugaagaaccaccuccgggacaucaugggcauccccuacugcaacuacuccaaguacugguaccugaaccacaccgugaccgggaagaccagccugccccgcugcuggcugguguccaacggcagcuaccugaacgagacgcacuucuccgacgacaucgagcagcaggccgacaacaugaucaccgagcuccugcagaaggaguaccuggaccggcagggcaagaccccgcucgggcuggucgaccuguucguguucagcaccuccuucuaccugaucagcaucuuccuccaccuggugaagaucccgacgcaccgccacgucaucggcaagcccugccccaagccccaccggcugaaccacauggggaucugcuccugcggccucuacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6014 - RNA, 1655 nt, Artificial Sequence
  mRNA product Design3 comprising derived and/or modified sequence from Lassa virus__AIT17608__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacaaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggcggcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6015 - RNA, 1655 nt, Artificial Sequence
  mRNA product Design3 comprising derived and/or modified sequence from Lassa virus__AIT17612__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacauccgggucggcaacgagaccggccuggagcucacccugaccaacacguccaucaucaaccacaaguucugcaaccugagcgacgcccacaagaagaaccucuacgaccacucccugaugagcaucaucuccaccuuccaccugagcauccccaacuucaaccaguacgaggccauguccugcgacuucaacgggggcaagaucagcgugcaguacaaccucucccacaccuacgccguggacgcggccaaccacugcgggaccaucgccaacggcguccugcagacguucaugcgcauggccuggggcgggagcuacaucgcgcuggacuccggcaaggggaacugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggccauccgccggcucaagaccgaggcgcagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacguggucggcaagcccugccccaagccccaccgccugaaccacauggggaucugcuccugcggccuguacaagcacccgggggugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6016 - RNA, 1655 nt, Artificial Sequence
  mRNA product Design3 comprising derived and/or modified sequence from Lassa virus__AIT17616__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacaucgaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6017 - RNA, 1655 nt, Artificial Sequence
  mRNA product Design3 comprising derived and/or modified sequence from Lassa virus__AIT17620__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucagccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacgcguacgccaucgacgccgccaaccacugcgggaccguggcgaacggcguccugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaaggccgaggcccagauguccauccagcugaucaacaaggccgugaacgcgcugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6018 - RNA, 1655 nt, Artificial Sequence
  mRNA product Design3 comprising derived and/or modified sequence from Lassa virus__AIT17626__GPC (opt1)
gggagaaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucauccagcacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucaccgugcaguacaaccucucccacagcuacgcgaucgacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggcgcaccagccugccccggugcuggcugguguccaacggcagcuaccugaacgagacccacuucuccgacgacaucgagcagcaggccgacaacaugaucacggagcuccugcagaaggaguacauggaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacaugggggugugcuccugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6019 - RNA, 1655 nt, Artificial Sequence
  mRNA product Design3 comprising derived and/or modified sequence from Lassa virus__AIT17630__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugcucuccuuccugcugcucugcggccgcagcugcuccacgaccuacaaggggguguacgagcugcagacccuggagcucgacauggccagccugaacaugaccaugccgcuguccugcacgaagaacaacagccaccacuacaucauggugggcaacgagaccggccucgagcugacccugaccaacacguccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacgcguacgccguggacgccgccgagcacugcgggaccaucgcgaacggcgugcugcagaccuucaugcggauggccuggggcggguccuacaucgcccucgacagcggcaagggguccugggacugcgucaugacgagcuaccaguaccugaucauccagaacaccuccugggaggaccacugccaguucagccgccccagccccaucggcuaccuggggcuccugucccagcggacccgcgacaucuacaucagccggcgccugcucggcaccuucacguggacccuguccgacagcgagggcaacgagacccccgggggcuacugccugacccgguggaugcucaucgaggccgagcugaagugcuucgggaacacggccguggcgaagugcaacgagaagcacgacgaggaguucugcgacaugcugcgccucuucgacuucaacaagcaggccauccggcgccugaagaccgaggcccagauguccauccagcugaucaacaaggccgugaacgcccucaucaacgaccagcugaucaugaagaaccaccuccgggacaucaugggcauccccuacugcaacuacagcaaguacugguaccugaaccacaccgucaccgggaagacgucccugccccgcugcuggcuggugagcaacggcuccuaccucaacgagacccacuucagcgacgacaucgagcagcaggcggacaacaugaucaccgagcugcugcagaaggaguacaucgaccggcagggcaagaccccgcucgggcugguggaccuguucgucuucuccacgagcuucuaccugaucuccaucuuccuccaccuggugaagaucccgacccaccgccacgugaucggcaagcccugccccaagccccaccggcugaaccacauggggaucugcagcugcggccucuacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6020 - RNA, 1655 nt, Artificial Sequence
  mRNA product Design3 comprising derived and/or modified sequence from Lassa virus__AIT17634__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaucuacaaggacguguacgagcuccagacccuggagcuggacauggccagccucaacaugaccaugccgcuguccugcaccaagaacaacagccaccacuacaucauggucgggaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacggcgggaagaucuccgugcaguacaaccucagccacaccuacgcgaucgacgccgccaaccacugcggcaccaucgccaacggggugcugcagaccuucaugcggauggcguggggcggguccuacaucgcccuggacagcggcaagggcuccugggacugcaucaugacgagcuaccaguaccucaucauccagaacaccaccugggaggaccacugccaguucucccgccccagccccaucggguaccugggccugcucagccagcggacccgcgacaucuacaucucccggcgccugcuggggacguucaccuggacccucagcgacuccgagggcaacgagaccccgggcggguacugccugacgcgguggaugcugaucgaggccgagcucaagugcuucggcaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucauggggauccccuacugcaacuacucccgcuacugguaccugaaccacaccgugacgggccggaccagccugccccgcugcuggcuggucuccaacgggagcuaccugaacgagacccacuucuccgacgacaucgagcagcaggccgacaacaugaucaccgagcuccugcagaaggaguacauggaccggcagggcaagacgccccugggccucguggaccuguucguguucagcaccuccuucuaccugaucagcaucuuccugcaccucgucaagaucccgacccaccgccacgugaucgggaagcccugccccaagccccaccggcugaaccacaugggcaucugcuccugcgggcuguacaaccacccgggcgugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6021 - RNA, 1655 nt, Artificial Sequence
  mRNA product Design3 comprising derived and/or modified sequence from Lassa virus__AIT17638__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucaucaagaucccgacccaccgccacaucacgggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6022 - RNA, 1655 nt, Artificial Sequence
  mRNA product Design3 comprising derived and/or modified sequence from Lassa virus__AIT17642__GPC (opt1)
gggagaaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgacaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccgucgacgccgccucccacugcgggaccaucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggaagaccucccugccccgcugcuggcuggugagcaacggcuccuaccugaacgagacccacuucagcgacgacaucgagcagcaggcggacaacaugaucaccgagcuccugcagaaggaguacauggaccggcagggcaagacgccccuggggcucgucgaccuguucguguucuccaccagcuucuaccugaucuccaucuuccugcaccucgugaagaucccgacccaccgccacaucaucggcaagcccugccccaagccccaccggcugaaccacauggggaucugcagcugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6023 - RNA, 1655 nt, Artificial Sequence
  mRNA product Design3 comprising derived and/or modified sequence from Lassa virus__AIT17646__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccucccacugcgggaccgucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggaagaccucccugccccgcugcuggcuggugagcaacggcuccuaccugaacgagacccacuucagcgacgacaucgagcagcaggcggacaacaugaucaccgagcuccugcagaaggaguacauggaccggcagggcaagacgccccuggggcucgucgaccuguucguguucuccaccagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6024 - RNA, 1655 nt, Artificial Sequence
  mRNA product Design3 comprising derived and/or modified sequence from Lassa virus__AIT17650__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacaucuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaaggccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgucaccgggcgcacgagccugccccggugcuggcugguguccaacggcagcuaccugaacgagacccacuucuccgacgacaucgagcagcaggcggacaacaugaucaccgagcuccugcagaaggaguacaucgaccgccagggcaagaccccgcuggggcucguggaccuguucgucuucagcacguccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6025 - RNA, 1655 nt, Artificial Sequence
  mRNA product Design3 comprising derived and/or modified sequence from Lassa virus__AIT17658__GPC (opt1)
gggagaaagcuuaccaugggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccaucacguacaagggggucuacgagcuccagacccuggagcuggacauggccaaccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcgugcaguacaaccucucccacaccuacgcgggggacgccgccgaccacugcggcaccaucgccaacgggguccugcagaccuucaugcggauggcguggggcggcagcuacaucgcccuggacuccgggaagggcagcugggacugcaucaugacguccuaccaguaccucaucauccagaacaccaccugggaggaccacugccaguucagccgccccucccccaugggguaccugggccugcucagccagcggacccgcgacaucuacaucagccggcgccugcugggcacguucaccuggacccucuccgacagcgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucauggggauccccuacugcaacuacagcaaguacugguaccugaaccacaccaucacgggcaagaccucccugccccgcugcuggcuggucagcaacggcuccuaccugaacgagacccacuucagcgacgacaucgagcagcaggccgacaacaugaucaccgagcuccugcagaaggaguacaucgaccggcaggggaagacgccccugggccucguggaccuguucguguucuccaccagcuucuaccugaucuccaucuuccugcaccucgucaagaucccgacccaccgccacaucaccgggaagcccugccccaagccccaccggcugaaccacaugggcaucugcagcugcgggcuguacaagcacccgggcgugcccgugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6026 - RNA, 1655 nt, Artificial Sequence
  mRNA product Design3 comprising derived and/or modified sequence from Lassa virus__AIT17666__GPC (opt1)
gggagaaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucgucgaccuguucguguucagcaccuccuucuaccugaucagcaucuuccugcaccucgugaagaucccgacccaccgccacaucacgggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6027 - RNA, 1655 nt, Artificial Sequence
  mRNA product Design3 comprising derived and/or modified sequence from Lassa virus__AIT17670__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaaggccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggcgcaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6028 - RNA, 1655 nt, Artificial Sequence
  mRNA product Design3 comprising derived and/or modified sequence from Lassa virus__AIT17674__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacaaccacgcccugaugagcaucaucuccaccuuccaccugagcauccccaacuucaaccaguacgaggccauguccugcgacuucaacgggggcaagaucagcgugcaguacaaccucucccacagcuacgccguggacgcggccaaccacugcgggaccaucgccaacggcguccugcagacguucaugcggauggccuggggcggguccuacaucgcgcuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagaccgaggcgcaggccaacauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6029 - RNA, 1655 nt, Artificial Sequence
  mRNA product Design3 comprising derived and/or modified sequence from Lassa virus__AIT17678__GPC (opt1)
gggagaaagcuuaccaugggccagaucaucaccuucuuccaggaggugccccacgucaucgaggaggugaugaacaucgugcugaucacccucagccugcuggccauccucaaggggaucuacaacaucgccacgugcggccuguucgggcuggucuccuuccuccugcugugcggccgcagcugcuccaccaccuacaaggggguguacgagcuccagacccuggagcuggacaugacgagccucaacaugaccaugccgcuguccugcaccaagaacaacagccaccacuacaucauggugggcaacgagaccggccuggagcucacgcugaccaacaccuccaucaucaaccacaaguucugcaaccugagcgacgcgcacaagaagaaccucuacgaccacgcccugauguccaucaucagcaccuuccaccuguccauccccaacuucaaccaguacgaggccaugagcugcgacuucaacgggggcaagaucuccguccaguacaaccucagccacacguacgccguggacgccgcgaaccacugcgggaccaucgccaacggcgugcugcagaccuucaugcggauggccuggggcggguccuacaucgcccuggacagcggcaagggguccugggacugcaucaugaccagcuaccaguaccucaucauccagaacacgaccugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggcggagcucaagugcuucgggaacacggccgucgccaagugcaacgagaagcacgacgaggaguucugcgacaugcugcgccuguucgacuucaacaagcaggccauccggcgccucaagaccgaggcccagaugagcauccagcugaucaacaaggcggugaacgcccugaucaacgaccagcucaucaugaagaaccaccuccgggacaucaugggcauccccuacugcaacuacuccaaguacugguaccugaaccacaccgugaccgggaagacgagccugccccgcugcuggcuggucuccaacggcagcuaccugaacgagacccacuucuccgacgacaucgagcagcaggccgacaacaugaucaccgagcuccugcagaaggaguacaucgaccggcagggcaagaccccgcuggggcucguggaccuguucguguucagcacguccuucuaccugaucagcaucuuccugcaccucgucaagaucccgacccaccgccacaucaucggcaagcccugccccaagccccaccggcugaaccacauggggaucugcuccugcggccuguacaagcacccggggauccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6030 - RNA, 1655 nt, Artificial Sequence
  mRNA product Design3 comprising derived and/or modified sequence from Lassa virus__AIT17686__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaccaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagccgcaagggcuccugggacugcaucaugaccagcuaccaguaccucaucauccagaacaccaccugggaggaccacugccaguucucccggcccagccccaucggguaccugggccugcucagccagcgcacgcgggacaucuacaucucccgccggcugcuggggaccuucaccuggacccucagcgacuccgagggcaacgagacgccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucauggggauccccuacugcaacuacuccaaguacugguaccugaaccacacggucaccggcaagaccagccugccccggugcuggcugguguccaacgggagcuaccugaacgagacccacuucuccgacgacaucgagcagcaggccgacaacaugaucacggagcuccugcagaaggaguacauggaccgccagggcaagacgccccugggccucguggaccuguucgucuucagcaccuccuucuaccugaucagcaucuuccugcaccucaucaagaucccgacccaccggcacgugaucgggaagcccugccccaagccccaccgccugaaccacaugggcaucugcuccugcgggcuguacaagcacccgggcgugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6031 - RNA, 1655 nt, Artificial Sequence
  mRNA product Design3 comprising derived and/or modified sequence from Lassa virus__AIT17690__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccucccacugcgggaccgucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggcgcaccucccugccccggugcuggcuggugagcaacggcuccuaccugaacgagacccacuucagcgacgacaucgagcagcaggcggacaacaugaucaccgagcuccugcagaaggaguacauggaccgccagggcaagacgccccuggggcucgucgaccuguucguguucuccaccagcuucuaccugaucuccaucuuccugcaccucgugaagaucccgacccaccggcacgucaucggcaagcccugccccaagccccaccgccugaaccacauggggaucugcagcugcggccuguacaagcacccgggggugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6032 - RNA, 1655 nt, Artificial Sequence
  mRNA product Design3 comprising derived and/or modified sequence from Lassa virus__AIT17694__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaucuacaaggggguguacgagcuccagacccuggagcuggacauggccagccucaacaugaccaugccgcuguccugcaccaagaacaacagccaccacuacaucauggucggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggccgacaacaugaucaccgagcuccugcagaaggaguacaucgaccggcagggcaagacgccccuggggcucguggaccuguucgucuucagcaccuccuucuaccugaucagcaucuuccugcaccucgugaagaucccgacccaccgccacguggucggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6033 - RNA, 1655 nt, Artificial Sequence
  mRNA product Design3 comprising derived and/or modified sequence from Lassa virus__AIT17712__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggggccugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccaucaugcggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggcggacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacgugaucggcaagcccugccccaagccccaccgccucaaccacauggggaucugcagcugcggccuguacaagcacccggggguccccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6034 - RNA, 1655 nt, Artificial Sequence
  mRNA product Design3 comprising derived and/or modified sequence from Lassa virus__AIT17718__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacauccgggucggcaacgagaccggccuggagcucacccugaccaacgccuccaucaucaaccacaaguucugcaaccugagcgacgcccacaagaagaaccucuacgaccacgcccugauguccaucaucagcacguuccaccuguccauccccaacuucaaccaguacgaggcgaugagcugcgacuucaacgggggcaagaucuccgugcaguacaaccucagccacgccuacgccaucgacgccgcgaaccacugcgggaccguggccaacggcguccugcagaccuucaugcgcauggccuggggcggguccuacaucgcccuggacagcggccgggggaacugggacugcaucaugaccuccuaccaguaccucaucauccagaacacgaccugggaggaccacugccaguucagccgccccucccccaucggcuaccuggggcugcucagccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggcgguggccaagugcaacgagaagcacgacgaggaguucugcgacaugcugcgccuguucgacuucaacaagcaggccauccggcgccucaagaccgaggcccagauguccauccagcugaucaacaaggccgugaacgcgcugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggcuucuacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6035 - RNA, 1655 nt, Artificial Sequence
  mRNA product Design3 comprising derived and/or modified sequence from Lassa virus__AIT17724__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgguggacgccgccaaccacugcgggaccgucgccaacggcgugcugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugccccgcugcuggcuggugagcaacggcuccuaccugaacgagacccacuucagcgacgacaucgagcagcaggccgacaacaugaucacggagcuccugcagaaggaguacauggaccggcagggcaagaccccgcuggggcucgucgaccuguucguguucuccaccagcuucuaccugaucuccaucuuccugcaccucgugaagaucccgacccaccgccacaucaugggcaagcccugccccaagccccaccggcugaaccacauggggaucugcagcugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6036 - RNA, 1655 nt, Artificial Sequence
  mRNA product Design3 comprising derived and/or modified sequence from Lassa virus__AIT17728__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaccaccuacaaggggguguacgagcuccagacccuggagcuggacaugggcagccucaacaugaccaugccgcuguccugcacgaagaacaacagccaccacuacaucauggucggcaacgagaccgggcuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacggcgggaagaucuccgugcaguacaaccucagccacaccuacgccguggacgcggccaaccacugcggcaccaucgccaacgggguccugcagacguucaugcggauggccuggggcggcuccuacaucgcgcuggacagcgggaagggcuccugggacugcaucaugaccagcuaccaguaccucaucauccagaacaccaccugggaggaccacugccaguucucccgccccagccccaucggguaccugggccugcucagccagcggacgcgcgacaucuacaucucccggcgccugcugggcaccuucaccuggacccucagcgacuccgaggggaacgagacgccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccggcgccucaagaccgaggcgcagaugagcauccagcugaucaacaaggccgugaacgcccugaucaacgaccagcucaucaugaagaaccaccuccgggacaucauggggauccccuacugcaacuacuccaaguacugguaccugaaccacacggucaccggcaagaccagccugccccgcugcuggcugguguccaacggcagcuaccugaacgagacccacuucuccgacgacaucgagcagcaggccgacaacaugaucacggagcuccugcagaaggaguacauggaccggcaggggaagacgccccugggccucguggaccuguucgucuucagcaccuccuucuaccugaucagcaucuuccugcaccucgugaagaucccgacccaccgccacgugaucgggaagcccugccccaagccccaccggcugaaccacaugggcaucugcuccugcgggcuguacaagcacccgggcguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6037 - RNA, 1655 nt, Artificial Sequence
  mRNA product Design3 comprising derived and/or modified sequence from Lassa virus__AIT17732__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacaucgugggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6038 - RNA, 1655 nt, Artificial Sequence
  mRNA product Design3 comprising derived and/or modified sequence from Lassa virus__AIT17736__GPC (opt1)
gggagaaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaugcggcucaagaccgaggcccagaugagcauccagcugaucaacaaggccgucaacgcccugaucaacgaccagcucaucaugaagaaccaccuccgcgacaucaugggcauccccuacugcaacuacuccaaguacugguaccugaaccacacggugaccgggaagaccagccugccccggugcuggcugguguccaacggcagcuaccugaacgagacccgcuucuccgacgacaucgagcagcaggccgacaacaugaucacggagaugcuccagaaggaguaccuggaccggcagggcaagaccccgcuggggcucgucgaccuguucguguucagcaccuccuucuaccugaucagcaucuuccugcaccucgugaagaucccgacccaccgccacaucaucggcaagcccugccccaagccccaccggcugaaccacauggggaucugcuccugcggccuguacaagcacccggggguccccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6039 - RNA, 1655 nt, Artificial Sequence
  mRNA product Design3 comprising derived and/or modified sequence from Lassa virus__AIT17744__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugauguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggugggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacgcguacgccguggacgccgccaaccacugcgggaccaucgcgaacggcgugcugcagaccuucaugcggauggccuggggcgggagcuacaucgcccuggacuccggcaaggggagcugggacugcaucaugacguccuaccaguaccucaucauccagaacaccagcugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggccgagcucaagugcuucgggaacacggccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgugaccgggaagacgagccugccccgcugcuggcuggucuccaacggcagcuaccugaacgagacccacuucuccgacgacaucgagcagcaggcggacaacaugaucaccgagcuccugcagaaggaguacaucgaccggcagggcaagaccccgcuggggcucguggaccuguucguguucagcacguccuucuaccugaucagcaucuuccugcaccucgucaagaucccgacccaccgccacgugaucggcaagcccugccccaagccccaccggcugaaccacauggggaucugcuccugcggccuguacaagcacccgggggugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6040 - RNA, 1655 nt, Artificial Sequence
  mRNA product Design3 comprising derived and/or modified sequence from Lassa virus__AIT17752__GPC (opt1)
gggagaaagcuuaccaugggccagaucaucaccuucuuccacgaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggccgcggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccgucgccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggugaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6041 - RNA, 1655 nt, Artificial Sequence
  mRNA product Design3 comprising derived and/or modified sequence from Lassa virus__AIT17756__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaucacguacaaggggguguacgagcuccagacccuggagcuggacauggccagccucaacaugaccaugccgcuguccugcaccaagaacaacagccaccacuacaucauggucggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggccgcggguccugggacugcaucaugacgagcuaccaguaccucaucauccagaacaccaccugggaggaccacugccaguucucccggcccagccccaucggcuaccuggggcugcucagccagcgcacccgggacaucuacaucucccgccggcugcugggcacguucaccuggacccucagcgacuccgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacaccgucaccgggcggacgagccugccccgcugcuggcugguguccaacggcagcuaccugaacgagacccacuucuccgacgacaucgagcagcaggcggacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacaucaucggcaagcccugccccaagccccaccggcugaaccacauggggaucugcuccugcggccuguacaagcacccgggggugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6042 - RNA, 1655 nt, Artificial Sequence
  mRNA product Design3 comprising derived and/or modified sequence from Lassa virus__AIT17758__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcugaacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugcgaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccgucacggggaagaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6043 - RNA, 1655 nt, Artificial Sequence
  mRNA product Design3 comprising derived and/or modified sequence from Lassa virus__AIT17762__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucagccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgguggacgccgccaaccacugcgggaccaucgccaacggcguccugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccagccccaucggcuaccuggggcugcucucccagcggacgcgcgacaucuacaucagccggcgccugcugggcaccuucaccuggacccucuccgacagcgagggcaacgaggcccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgugaacgcccugaucaacgaccagcucaucaugaagaaccaccuccgggacaucaugggcaucccguacugcaacuacagccgcuacugguaccugaaccacaccgucacggggaagaccucccugccccggugcuggcuggugagcaacggcuccuaccugaacgagacccacuucagcgacgacaucgagcagcaggcggacaacaugaucaccgagcuccugcagaaggaguacauggaccgccagggcaagacgccccuggggcucguggaccuguucgucuucuccaccagcuucuaccugaucuccaucuuccugcaccucgugaagaucccgacccaccggcacgugaucggcaagcccugccccaagccccaccgccugaaccacauggggaucugcagcugcggccuguacaagcacccggggguccccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6044 - RNA, 1655 nt, Artificial Sequence
  mRNA product Design3 comprising derived and/or modified sequence from Lassa virus__AIT17770__GPC (opt1)
gggagaaagcuuaccaugggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccaggcccuggagcuggacaugagcucccucaacaugaccaugccgcugagcugcaccaagaacaacucccaccacuacaucauggugggcaacgagacgggccuggagcucacccugaccaacaccagcaucauccaccacaaguucugcaaccuguccgacgcccacaagaaggaccucuacgaccacgcccugaugagcaucaucuccacguuccaccugagcauccccaacuucaaccaguacgaggccauguccugcgacuucaacgggggcaagaucagcgugcaguacaaccucucccacaccuacgcggucgacgccgccaaccacugcgggaccaucgccaacggcgugcugcagaccuucaugcggauggcguggggcgggagcuacaucgcccuggacuccggcaagggcgggugggacugcaucaugacgagcuaccaguuccucaucauccagaacaccaccugggaggaccacugccaguucucccgccccagccccaucggguaccugggccugcucagccagcggacccgcgacaucuacaucucccggcgccugcugggcacguucaccuggacccucagcgacuccgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggcgaucaagcggcucaagaccgaggcccagaugagcauccaccugaucaacaaggccgucaacgcccugaucaacgaccagcucaucaugaagaaccaccuccgcgacaucauggggauccccuacugcaacuacuccaaguacugguaccugaaccacaccgugacgggcaagaccagccugccccggugcuggcugguguccaacggcagcuaccugaacgagacccacuucuccgacgacaucgagcagcaggccgacaacaugaucaccgagcuccugcagaaggaguacaucgaccgccaggggaagacgccccugggccucgucgaccuguucguguucagcaccuccuucuaccugaucagcaucuuccugcaccucgugaagaucccgacccaccggcacgucaucgggaagcccugccccaagccccaccgccugaaccacaugggcaucugcuccugcgggcuguacaagcacccgggcgugcccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6045 - RNA, 1655 nt, Artificial Sequence
  mRNA product Design3 comprising derived and/or modified sequence from Lassa virus__AIT17778__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgcgggacgccgccaaccacugcgggaccaucgccaacggcgugcugcagacguucaugcgcauggcguggggcgggagcuacaucgcccuggacuccggcaaggggagcugggacugcaucaugaccuccuaccaguaccucaucauccagaacaccaccugggaggaccacugccaguucagccggcccucccccaucggcuaccuggggcugcucagccagcgcacgcgggacaucuacaucagccgccggcugcugggcaccuucaccuggacccucuccgacagcgagggcaacgagacgcccgggggcuacugccugacccgcuggaugcugaucgaggccgagcucaagugcuucgggaacaccgccgucgccaagugcaacgagaagcacgacgaggaguucugcgacaugcugcggcuguucgacuucaacaagcaggcgauccgccggcucaagaccgaggcccagaugaacauccagcugaucaacaaggccgugaacgcccugaucaacgaccagcucaucaugaagaaccaccuccgcgacaucaugggcauccccuacugcaacuacuccaaguacugguaccugaaccacacggugaccgggaagaccagccugccccggugcuggcuggucuccaacggcagcuaccugaacgagacccacuucuccgacgacaucgagcagcaggccgacaacaugaucacggagcuccugcagaaggaguacauggaccgccagggcaagaccccgcuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6046 - RNA, 1655 nt, Artificial Sequence
  mRNA product Design3 comprising derived and/or modified sequence from Lassa virus__AIT17782__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaagcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacguggucggcaagcccugccccaagccccaccgccugaaccacauggggaucugcuccugcggccuguacaagcacccgggggugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6047 - RNA, 1655 nt, Artificial Sequence
  mRNA product Design3 comprising derived and/or modified sequence from Lassa virus__AIT17786__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccaucgacgccgccgaccacugcgggaccaucgcgaacggcgugcugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgugacggggaagaccagccugccccgcugcuggcuggucuccaacggcagcuaccugaacgagacccacuucuccgacgacaucgagcagcaggcggacaacaugaucaccgagcuccugcagaaggaguacauggaccggcagggcaagacgccccuggggcucguggaccuguucguguucagcaccuccuucuaccugaucagcaucuuccugcaccucgucaagaucccgacccaccgccacaucaccggcaagcccugccccaagccccaccggcugaaccacauggggaucugcuccugcggccuguacaagcacccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6048 - RNA, 1655 nt, Artificial Sequence
  mRNA product Design3 comprising derived and/or modified sequence from Lassa virus__AIT17790__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucgugaagaucccgacccaccgccacaucacgggcaagcccugccccaagccccaccggcugaaccacauggggaucugcuccugcggccuguacaagcacccgggggugcccgucaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6049 - RNA, 1655 nt, Artificial Sequence
  mRNA product Design3 comprising derived and/or modified sequence from Lassa virus__AIT17798__GPC (opt1)
gggagaaagcuuaccaugggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaugcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagaugcuccagaaggaguaccuggaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6050 - RNA, 1658 nt, Artificial Sequence
  mRNA product Design3 comprising derived and/or modified sequence from Lassa virus__AIT17802__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacaaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcgaccggugggacugcaucaugaccagcuaccaguaccugaucauccagaacaccacgugggaggaccacugccaguucucccgccccagccccaucggcuaccucgggcugcugucccagcggacccgcgacaucuacaucagccggcgccuccugggcaccuucaccuggacgcugagcgacuccgagggcaaggacacccccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcauccccuacugcaacuacuccaaguacugguaccugaaccacacgaccaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcucggcaagaccccgcuggggcuggucgaccuguucguguucagcaccuccuucuaccucaucagcaucuuccugcaccuggugaagaucccgacgcaccgccacaucgucggccgguccugccccaagccccaccgccucaaccacauggggaucugcagcugcggccuguacaagcagcccggggugccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6051 - RNA, 1658 nt, Artificial Sequence
  mRNA product Design3 comprising derived and/or modified sequence from Lassa virus__AIT17806__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggcaagugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6052 - RNA, 1658 nt, Artificial Sequence
  mRNA product Design3 comprising derived and/or modified sequence from Lassa virus__AIT17810__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaaggacaacagccaccacuacauccgggugggcaacgagaccggccuggagcugacgcucaccaacaccuccauccugaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggccgcaucuccguccaguacaaccucagccacuccuacgccggggacgcggccaaccacugcggcacgguggccaacggggugcugcagaccuucaugcggauggccuggggcggcagcuacaucgcgcuggacuccgggcgcggccggugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugccccggugcuggcugguguccaacggcagcuaccugaacgagacgcacuucuccgacgacaucgagcagcaggccgacaacaugaucaccgagaugcuccagaaggaguacauggagcgccaggggaagacgccccugggccuggucgaccuguucguguucagcaccuccuucuaccucaucagcaucuuccugcaccuggugaagaucccgacccaccggcacgucguggggaagcccugccccaagccccaccgccucaaccacaugggcaucugcuccugcgggcuguacaagcagccgggcgugcccgucaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6053 - RNA, 1658 nt, Artificial Sequence
  mRNA product Design3 comprising derived and/or modified sequence from Lassa virus__AIT17814__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucgaccacaaguucugcaaccucagcgacgcccaccggaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccaaggacgcggccgaccacugcgggacgguggccaacggcgugcugcagaccuucaugcgcauggccuggggcgggagcuacaucgcgcucgacuccggccgggggcgcugggacugcaucaugaccagcuaccaguaccugaucauccagaacaccacgugggaggaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcgccagggcaagaccccgcuggggcucgucgaccuguucguguucagcaccuccuucuaccugaucagcaucuuccugcaccucgugaagaucccgacgcaccggcacaucgucggcaagcccugccccaagccccaccgccugaaccacauggggaucugcuccugcggccuguacaagcagccgggggugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6054 - RNA, 1658 nt, Artificial Sequence
  mRNA product Design3 comprising derived and/or modified sequence from Lassa virus__AIT17820__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccgaggacgcggccaaccacugcgggacgguggccaacggcgugcugcagaccuucaugcggauggccuggggcgggagcuacaucgcgcucgacuccggccgcgggaacugggacugcaucaugaccagcuaccaguaccugaucauccagaacaccacgugggaggaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcgccagggcaagaccccgcuggggcucgucgaccuguucguguucagcaccuccuucuaccugaucagcaucuuccugcaccucgugaagaucccgacgcaccggcacaucgucggcaaguccugccccaagccccaccgccugaaccacauggggaucugcagcugcggccuguacaagcagcccggggugccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6055 - RNA, 1658 nt, Artificial Sequence
  mRNA product Design3 comprising derived and/or modified sequence from Lassa virus__AIT17824__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagcguguacaaggggguguacgagcuccagacccuggagcugaacauggagacgcucaacaugaccaugccgcuguccugcaccaagaacaacagccaccacuacaucauggucggcaacgagaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacuccuacgccggggacgcggccaaccacugcggcacgguggccaacgggguccugcagaccuucaugcggauggccuggggcggcagcuacaucgcgcuggacuccgggcacggcaagugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugcccaagugcuggcuggucuccaacggcagcuaccugaacgagacgcacuucuccgacgacaucgagcagcaggccgacaacaugaucaccgagaugcuccagaaggaguacauggagcggcaggggaagacgccccugggccugguggaccucuucguguucagcaccuccuucuaccugaucagcaucuuccugcaccuggucaagaucccgacccaccgccacaucguggggaaguccugccccaagccccaccggcucaaccacaugggcaucugcagcugcgggcuguacaagcagcccggcgugccgguccgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6056 - RNA, 1658 nt, Artificial Sequence
  mRNA product Design3 comprising derived and/or modified sequence from Lassa virus__AIT17828__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaagggggacuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6057 - RNA, 1655 nt, Artificial Sequence
  mRNA product Design3 comprising derived and/or modified sequence from Lassa virus__AIT17836__GPC (opt1)
gggagaaagcuuaccaugggccagaucaucaccuucuuccaggaggugccccacgucaucgaggaggugaugaacaucgugcugaucgcccucagccugcuggccauccucaaggggcuguacaacaucgcgaccugcggcaucaucgggcuggucgccuuccucuuccugugcggcaaguccugcagccugacgcucaagggcggguacgagcugcagacccuggagcucaacauggagacccugaacaugaccaugccgcuguccugcacgaagaacagcucccaccacuacauccgcgugggcaacgagaccgggcucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacggcgggaagaucagcgugcaguacaaccugucccacagcuacgcgggcgacgccgccgagcacugcgggaccgucgccaacggcgugcugcagaccuucaugcggauggcguggggcgggcgcuacaucgcccucgacuccggcaaggggaacugggacugcaucaugacgagcuaccaguaccugaucauccagaacaccaccugggaggaccacugccaguucucccggcccagccccaucggcuaccugggccuccugucccagcgcacccgggacaucuacaucagccgccggcugcucgggacguucaccuggacccugagcgacuccgagggcaacgagacccccgggggcuacugccugacgcgcuggaugcucaucgaggccgagcugaagugcuucgggaacaccgccguggccaagugcaacgagaagcacgacgaggaguucugcgacaugcugcggcuguucgacuucaacaagcaggcgauccgccggcugaaggccgaggcccagaugagcauccagcugaucaacaaggccgucaacgcccucaucaacgaccagcugaucaugaagaaccaccuccgcgacaucaugggcauccccuacugcaacuacuccaaguacugguaccucaaccacaccagcuccggccggaccagccugcccaagugcuggcugaucuccaacgggagcuaccucaacgagacgcaguucuccgacgacaucgagcagcaggcggacaacaugaucaccgagaugcugcagaaggaguacaucgagcgccagggcaagaccccgcuggggcucguggacaucuucaucuucagcaccuccuucuaccugaucagcaucuuccugcaccugaucaagaucccgacgcaccggcacaucgugggcaagcccugccccaagccccaccgccucaaccacaugggggucugcuccugcggccuguacaagcacccgggcgugcccaccaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6058 - RNA, 1658 nt, Artificial Sequence
  mRNA product Design3 comprising derived and/or modified sequence from Lassa virus__AIT17840__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaucagccucuacaaggggguguacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcgaccggugggacugcaucaugaccagcuaccaguaccugaucauccagaacaccaccugggaggaccacugccaguucucccgccccagccccaucggcuaccuggggcuccugucccagcggacgcgcgacaucuacaucagccggcgccugcucggcaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacaccacgaccgggaagaccagccugcccaagugcuggcugguguccaacggcagcuaccucaacgagacccacuucuccgacgacaucgagcagcaggccgacaacaugaucacggagaugcugcagaaggaguacauggagcggcagggcaagaccccgcuggggcucgucgaccuguucguguucagcaccuccuucuaccugaucagcaucuuccugcaccucgugaagaucccgacccaccgccacaucgucggcaagcccugccccaagccccaccggcugaaccacauggggaucugcuccugcggccuguacaagcagccgggggugcccgugaaguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6059 - RNA, 1658 nt, Artificial Sequence
  mRNA product Design3 comprising derived and/or modified sequence from Lassa virus__AIT17844__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaucagccucuacaaggggguguacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcgaccggugggacugcaucaugaccagcuaccaguaccugaucauccagaacaccaccugggaggaccacugccaguucucccgccccagccccaucggcuaccuggggcuccugucccagcggacgcgcgacaucuacaucagccggcgccugcucggcaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaaccgcgccgugaacgcccucaucaacgaccagcugaucaugaagaaccaccuccgggacaucaugggcauccccuacugcaacuacuccaaguacugguaccugaaccacaccacgaccgggaagaccagccugcccaagugcuggcugguguccaacggcagcuaccucaacgagacccacuucuccgacgacaucgagcagcaggccgacaacaugaucacggagaugcugcagaaggaguacauggagcgccagggcaagaccccgcuggggcucgucgaccuguucguguucagcaccuccuucuaccugaucagcaucuuccugcaccucgugaagaucccgacccaccggcacaucgucggcaagcccugccccaagccccaccgccugaaccacauggggaucugcuccugcggccuguacaagcagccgggggugcccgugaaguggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6060 - RNA, 1655 nt, Artificial Sequence
  mRNA product Design3 comprising derived and/or modified sequence from Lassa virus__AMR44577__GPC (opt1)
gggagaaagcuuaccaugggccagaucaucaccuucuuccaggaggugccccacgucaucgaggaggugaugaacaucgugcugaucgcccucagccugcuggccauccucaagggggucuacaacguggcgaccugcggcaucaucgggcuggugacguuccuguuccucugcggccgcuccugcagccugaucuacaagggguccuacgagcugcagacccucgagcugaacauggagacccugaacaugaccaugccgcucagcugcacgaagaacuccagccaccacuacauccgggucggcaacgagaccggccuggagcugacccucaccaacacguccaucaucaaccacaaguucugcaaccugagcgacgcccacaagcgcaaccuguacgaccacgcccucauguccauccugagcaccuuccaccuguccauccccaacuucaaccaguacgaggccaugagcugcgacuucaacgggggcaagaucuccgugcaguacaaccucagccacgccuacgcgguggacgccgccgagcacugcgggaccgucgccaacggcgugcugcagaccuucaugcggauggcguggggcggguccuacaucgcccuggacagcggccgcgggaacugggacugcaucaugacguccuaccaguaccucaucauccagaacaccaccugggaggaccacugccaguucagccggcccucccccaucggcuaccuggggcugcucagccagcgcacccgggacaucuacaucagccgccggcugcugggcacguucaccuggacccucuccgacagcgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccagcgccucaaguccgaggcccagaugagcauccagcugaucaacaaggccgucaacgcccugaucaacgaccagcucaucaugaagaaccaccuccgggacaugaugggcauccccuacugcaacuacuccaaguacugguaccugaaccacaccagcuccgggcgcaccagccugcccaagugcuggcugguguccaacggcagcuaccugaacgagacgcacuucuccgacgacaucgagcagcaggccgacaacaugaucaccgagaugcuccagaaggaguacaucgaccggcagggcaagaccccgcuggggcugguggaccucuucgucuucagcaccuccuucuaccugaucagcaucuuccugcaccugaucaagaucccgacgcaccgccacaucgugggcaagcccugccccaagccccaccggcucaaccacauggggaucugcuccugcggccuguacaagcagccgggggugcccacccgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6061 - RNA, 1658 nt, Artificial Sequence
  mRNA product Design3 comprising derived and/or modified sequence from Lassa virus__ANH09722__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagccucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgacgggaagaucagcguccaguacaaccugucccacacguacgcgggcgacaccgccaaccacugcgggaccguggccaacggcgugcuccagaccuucaugcgcauggccuggggcgggagcuacaucgcgcuggacuccggccgcgggggcugggacugcaucaugacgagcuaccaguaccugaucauccagaacaccaccugggaggaccacugccaguucucccggcccagccccaucggguaccucggccugcugucccagcggacccgcgacaucuacaucagccggcgccuccugggcacguucaccuggacccuguccgacagcgaggggaaggacaccccgggcggguacugccucacgcgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucauggggauccccuacugcaacuacuccaaguacugguaccugaaccacaccgugaccggcaagacgagccugcccaagugcuggcucgucuccaacggcagcuaccugaacgagacccacuucuccgacgacaucgagcagcaggccgacaacaugaucaccgagaugcugcagaaggaguacauggagcggcaggggaagacgccccucggccugguggaccuguucguguucagcaccuccuucuaccugaucagcaucuuccuccaccuggucaagaucccgacccaccgccacgugguggggaagcccugccccaagccccaccggcugaaccacaugggcaucugcuccugcggguucuacaagcagccgggcguccccgugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6062 - RNA, 1658 nt, Artificial Sequence
  mRNA product Design3 comprising derived and/or modified sequence from Lassa virus__ANH09724__GPC (opt1)
gggagaaagcuuaccaugggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacgacucccaccacuacaucauggugggcaacgagaccggccucgagcugacgcugaccaacaccagcaucaucucccacaaguucugcaaccucagcgacgcccacaagcagaaccuguacgaccacgcccugauguccaucaucagcaccuuccaccucuccauccccaacuucaaccaguacgaggccaugagcugcgacuucaacgggggcaagaucuccguccaguacaaccugagccacacguacgcgggggacgccgccaaccacugcggcaccguggccaacggggugcugcagaccuucaugcggauggcguggggcggcuccuacaucgcccucgacagcgggcgcggcgggugggacugcaucaugaccuccuaccaguaccugaucauccagaacacgaccugggaggaccacugccaguucagccggcccucccccaucggcuaccugggccuccugagccagcgcacccgggacaucuacaucucccgccggcugcucgggaccuucacguggacccugagcgacagcgagggcaaggacacccccgggggcuacugccugacccgcuggaugcucaucgaggccgagcugaagugcuucgggaacacggccgucgccaagugcaacgagaagcacgacgaggaguucugcgacaugcugcggcuguucgacuucaacaagcaggcgauccagcgccugaaggccgaggcccagauguccauccagcugaucaacaaggccgugaacgcccucaucaacgaccagcugaucaugaagaaccaccuccgggacaucaugggcauccccuacugcaacuacagcaaguacugguaccucaaccacaccgugaccggcaagaccucccugcccaagugcuggcuggucagcaacggguccuaccucaacgagacgcacuucagcgacgacaucgagcagcaggcggacaacaugaucaccgagaugcugcagaaggaguacauggagcgccagggcaagaccccgcuggggcucguggaccuguucguguucuccaccagcuucuaccugaucuccaucuuccugcaccucgucaagaucccgacgcaccggcacguggugggcaagcccugccccaagccccaccgccugaaccacauggggaucugcagcugcggcuucuacggccagccggggguccccgugcgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6063 - RNA, 1658 nt, Artificial Sequence
  mRNA product Design3 comprising derived and/or modified sequence from Lassa virus__ANH09728__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacgucgcgaccugcggccugaucgggcuggugacguuccuccugcugugcggccgcuccugcaccaccacccucuacaaggggguguacgagcugcaggcccuggagcucaacaugggcacgcugaacaugaccaugccgcugagcugcaccaagaacaacucccaccacuacaucauggucggcaacgagaccgggcucgagcugacgcugaccaacaccagcaucaucaaccacaaguucugcaaccucuccgacgcccacaagaaggaccuguacgaccacgcccugaugagcaucaucuccaccuuccaccucagcgugcccaacuucaaccaguacgaggccauguccugcgacuucaacggcgggaagaucagcgugcaguacaaccugucccacgcguacgccggcgacacggccaaccacugcgggaccgucgccaacggcgugcugcagaccuucaugcggauggcguggggcgggagcuacaucgcccucgacuccggccgcgggggcugggacugcaucaugaccagcuaccaguaccugaucauccagaacacgaccugggaggaccacugccaguucucccggcccagccccaucggcuaccuggggcuccugucccagcgcacccgggacaucuacaucagccgccggcugcucggcaccuucacguggacccuguccgacagcgagggggaguacaccccgggcggguacugccugacccgcuggaugcucaucgaggccgagcugaagugcuucggcaacacggccguggccaagugcaacgagaagcacgacgaggaguucugcgacaugcugcggcuguucgacuucaacaagcaggcgauccagcgccugaaggccgaggcccagaugagcauccagcugaucaacaaggccgucaacgcccucaucaacgaccagcugaucaugaagaaccaccuccgggacaucaugggcauccccuacugcaacuacuccaaguacugguaccucaaccacaccgugaccgggaagaccagccugcccaagugcuggcugguguccaacggcagcuaccucaacgagacgcacuucuccgacgacaucgagcagcaggcggacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacgucguggggaagcccugccccaagccccaccgccugaaccacaugggcaucugcuccugcggcuucuacaagcagccgggggugcccguccgguggaagcgcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6064 - RNA, 1658 nt, Artificial Sequence
  mRNA product Design3 comprising derived and/or modified sequence from Lassa virus__ANH09730__GPC (opt1)
gggagaaagcuuaccaugggccagaucgugaccuucuuccaggaggucccccacgugaucgaggaggugaugaacaucguccugaucgcccucagcgugcuggccgugcugaaggggcucuacaacgucgcgaccugcggccugaucgggcuggugacguuccuccugcugugcggccgcuccugcaccaccacccucuacaaggggguguacgagcugcaggcccuggagcucaacauggagacgcugaacaugaccaugccgcugagcugcaccaagaacaacucccaccacuacaucauggucggcaacgagaccggccucgagcugacgcugaccaacaccagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaaccaggggaagaucagcgugcaguacaaccugucccacgcguacgccggcgacgccgccaaccacugcgggacgguggcgaacggcguccugcagaccuucaugcggauggccuggggcgggagcuacaucgcccucgacuccggccgcgggggcugggacugcaucaugaccagcuaccaguaccugaucauccagaacaccacgugggagaaccacugccaguucucccggcccagccccaucggguaccugggccuccugucccagcgcacccgggacaucuacaucagccgccggcugcucggcaccuucaccuggacgcuguccgacagcgaggggaagggcacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgcuucaaggccgaggcccagaugagcauccagcugaucaacaaggccgugaacgcgcugaucaacgaccagcucaucaugaagaaccaccuccgggacaucaugggcauccccuacugcaacuacuccaaguacugguaccugaaccacacggucaccggcaagaccagccuccccaagugcuggcugguguccaacgggagcuaccugaacgagacccacuucuccgacgacaucgagcagcaggccgacaacaugaucacggagaugcuccagaaggaguacauggagcgccagggccggaccccgcuggggcugguggaccucuucgucuucagcaccuccuucuaccugaucagcaucuuccugcaccuggugaagaucccgacccaccgccacguggucggcaagcccugccccaagccccaccggcucaaccacauggggaucugcuccugcggcuucuacaagcagccgggcgugcccgugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6065 - RNA, 1658 nt, Artificial Sequence
  mRNA product Design3 comprising derived and/or modified sequence from Lassa virus__ANH09732__GPC (opt1)
gggagaaagcuuaccaugggccagaucgugaccuucuuccaggaggucccccacgugaucgaggaggugaugaacaucguccugaucgcccucagcauccuggccgugcugaaggggguguacaacgucgcgaccugcggccucaucgggcuggugacguuccugcuccuguccggccgcagcugcaccaccaccaucuacaaggggguguacgagcugcaggcccucgagcugaacauggagacgcugaacaugaccaugccgcucuccugcaccaagaacaacagccaccacuacaucauggucggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacacguacgcgggggacgccgccaaccacugcggcaccguggccaacgggguccuccagaccuucaugcggauggcguggggcggcuccuacaucgcccuggacagcgggcacggcgggugggacugcaucaugaccuccuaccaguaccugaucauccagaacacgaccugggagaaccacugccaguucagccgccccucccccaucggcuaccucggccugcugagccagcggacccgcgacaucuacaucucccggcgccuccuggggaccuucacguggacccugagcgacagcgagggcaaggacacccccgggggcuacugccucacccgguggaugcugaucgaggccgagcugaagugcuucgggaacacggccguggccaagugcaacgagaagcacgacgaggaguucugcgacaugcuccgccuguucgacuucaacaagcaggcgauccagcggcugaaggccgaggcccagauguccauccagcucaucaacaaggccgugaacgcccugaucaacgaccagcugaucaugaagaaccaccuccgcgacaucaugggcauccccuacugcaacuacagcaaguacugguaccugaaccacaccgucaccggcaagaccucccugcccaagugcuggcucgugagcaacggguccuaccugaacgagacgcacuucagcgacgacaucgagcagcaggcggacaacaugaucaccgagaugcugcagaaggaguacauggagcggcagggcaagaccccgcucgggcugguggaccuguucgucuucuccaccagcuucuaccucaucuccaucuuccugcaccuggugaagaucccgacgcaccgccacaucgugggcaagcccugccccaagccccaccggcugaaccacauggggaucugcagcugcggcuucuacaagcagccgggcguccccgugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6066 - RNA, 1655 nt, Artificial Sequence
  mRNA product Design3 comprising derived and/or modified sequence from Lassa virus__ANH09738__GPC (opt1)
gggagaaagcuuaccaugggccagaucgugaccuucuuccaggaggucccccacgugaucgaggagaucaugaacaucgugcugaucacccucagccugcuggccauccucaaggggcuguacaacuucgccacgugcggccugaucgggcucaucaccuuccuguuccugugcggccgcuccugcagcaugaucuacaagggguccuaccagcucgagacccuggagcugaacauggagacccucaacaugacgaugccgcugagcugcaccaagaacaacucccaccacuacauccgggucggcaacgagaccggccuggagcucacccugacgaacaccagcaucaucaaccacaaguucugcaaccuguccgacgcgcacaagcgcaaccucuacgaccacagccugauguccaucaucagcaccuuccaccuguccauccccaacuucaaccaguacgaggccaugagcugcgacuucaacgggggcaagaucuccauccaguacaaccucagccacaccuacgccggggacgccgccaagcacugcggcacgguggcgaacggggugcugcagaccuucaugcggauggccuggggcggcuccuacaucgcccuggacagcgggcgcggcaacugggacugcaucaugaccuccuaccaguaccucaucauccagaacaccacgugggaggaccacugccaguucagccggcccucccccaucggguaccugggccugcucagccagcgcacccgggacaucuacaucagccgccggcugcugggcaccuucaccuggacgcucuccgacagcgaggggaaggagaccccgggcggguacugccugacccgcuggaugcugaucgaggccgagcucaagugcuucggcaacaccgcggucgccaagugcaacgagaagcacgacgaggaguucugcgacaugcugcggcuguucgacuucaacaagcaggccauccagcgccucaagacggaggcccagauguccauccagcugaucaacaaggccgugaacgcgcugaucaacgaccagcucaucaugaagaaccaccuccgggacaucauggggauccccuacugcaacuacagcaaguacugguaccugaaccacaccuccaccggccgcaccagccugcccaagugcuggcugguguccaacggcagcuaccugaacgagacgcacuucuccgacgacaucgagcagcaggccgacaacaugaucaccgagaugcuccagaaggaguacaucgaccggcaggggaagacgccccugggccuggucgacguguucauguucagcaccuccuucuaccucaucagcaucuuccugcaccuggugaagaucccgacccaccgccacaucgucgggaaguccugccccaagccccaccggcugaaccacaugggcaucugcagcugcgggcucuacaagcagcccggcgugccggugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6067 - RNA, 1655 nt, Artificial Sequence
  mRNA product Design3 comprising derived and/or modified sequence from Lassa virus__ANH09740__GPC (opt1)
gggagaaagcuuaccaugggccagaucgugaccuucuuccaggaggucccccacgugaucgaggaggugaugaacaucguccugaucgcccucagccugcuggccauccucaaggggcuguacaacuucgcgaccugcggcgugaucgggcugaucacguuccuccugcugugcggccgcuccugcagcgccaccuacaaggggcaguacgagcuccagacccuggagcugaacauggagucccucaacaugaccaugccgcugagcugcacgaagaacaacucccaccacuacauccgggccggcaacaacaccggccuggagcucacccugaccaacacgagcaucaucucccacaaguucugcaaccugagcgacgcccacaagaagaaccucuacgaccacacccugauguccaucaucaccaccuuccaccugagcauccccaacuucaaccaguacgaggccauguccugcgacuucaacgggggcaagaucagcauccaguacaaccucucccacagcuacgcgggggacgccgcccagcacugcggcacgguggccaacgggguccugcagaccuucaugcgcauggcguggggcggcuccuaccuggcccucgacagcgggcggcgcggcugggacugcaucaucuccagcuaccaguaccugaucauccagaacaccaccugggacgaccacugccaguucucccggcccagccccaucggguaccugggcuucgugagccagaagacgcgcgacaucuacaucucccggcgccuccugggcaccuucaccuggacccugagcgacuccgaggggcacgacaugccgggcggguacugccucacgcgguggaugcugaucgaggccgaccugaagugcuucggcaacaccgccguggccaagugcaacgagaagcacgacgaggaguucugcgacauguggcgccucuucgacuucaacaagcaggcgauccagcggcugaaggccgaggcccagaugaacauccagcugaucaacaaggccgucaacgcccucaucaacgaccagcugaugaugaagaaccaccuccgcgacaucauggggauccccuacugcaacuacagcaaguucugguaccugaacaacaccaccacgggccggaccucccugccccgcugcuggcugaucagcaacggcuccuaccucaacgagacccacuucagcgacgacaucgagcagcaggcggacaacaugaucaccgagaugcugcagaaggaguacauggaccggcaggggaagacgccccugggccucguggaccuguucguguucuccaccagcuucuaccugaucaccaucuuccuccaccuggucaagaucccgacccaccgccacaucguggggaagcccugccccaagccccaccggcugaaccacaugggcaucugcuccugcgggcuguacaagcagccgggcgugcccguccgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6068 - RNA, 1655 nt, Artificial Sequence
  mRNA product Design3 comprising derived and/or modified sequence from Lassa virus__CAA36645__GPC (opt1)
gggagaaagcuuaccaugggccagaucgugaccuucuuccaggaggucccccacgugaucgaggaggugaugaacaucguccugaucgcccucagcauccuggccauccugaaggggcucuacaacguggcgaccugcggccugaucgggcuggugacguuccuccugcuguccggccgcagcugcucccucaucuacaaggggaccuacgagcugcagacccuggagcucaacauggagacccugaacaugacgaugccgcugagcugcaccaagaacaacucccaccacuacauccgggucggcaacgagaccggccucgagcugacccugacgaacaccagcauccucaaccacaaguucugcaaccuguccgacgcccacaagcgcaaccuguacgaccacagccucauguccaucaucagcaccuuccaccuguccauccccaacuucaaccaguacgaggccaugagcugcgacuucaacgggggcaagaucaccgugcaguacaaccugucccacagcuucgccguggacgccgcggggcacugcggcacgcucgccaacgggguccugcagaccuucaugcggauggccuggggcggcuccuacaucgcccuggacagcgggcgcggcaacugggacugcaucaugaccuccuaccaguaccucaucauccagaacaccacgugggacgaccacugccaguucagccggcccucccccaucggguaccugggccugcucagccagcgcacccgggacaucuacaucagccgccggcugcugggcaccuucaccuggacgcucuccgacagcgaggggaacgagaccccgggcggguacugccugacccgcuggaugcugaucgaggcggagcucaagugcuucggcaacaccgccguggccaagugcaacgagaagcacgacgaggaguucugcgacaugcugcggcuguucgacuucaacaagcaggccauccgccggcucaagacggaggcccagauguccauccagcugaucaacaaggcggugaacgcccugaucaacgaccagcucaucaugaagaaccaccuccgcgacaucauggggauccccuacugcaacuacagccgguacugguaccugaaccacaccuccaccggcaagaccagccugccccgcugcuggcugaucuccaacggcagcuaccugaacgagacgaaguucuccgacgacaucgagcagcaggccgacaacaugaucaccgagaugcuccagaaggaguacaucgaccggcaggggaagacgccccugggccuggucgaccuguucguguucagcaccuccuucuaccucaucagcaucuuccugcaccuggugaagaucccgacccaccgccacaucgucgggaagcccugccccaagccccaccggcucaaccacaugggcaucugcuccugcgggcuguacaagcagccgggcgugcccgugcgcuggaagcggugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6069 - RNA, 1658 nt, Artificial Sequence; identical to SEQ ID NO: 5889
  mRNA product Design3 comprising derived and/or modified sequence from Lassa virus__NP_694870__GPC (opt1)

SEQ ID NO: 6070 - RNA, 1895 nt, Artificial Sequence
  mRNA product Design3 comprising derived and/or modified sequence from Lassa virus__AAA46284__NP (opt1)
gggagaaagcuuaccaugagcgccuccaaggaggugcgcagcugccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagaagcgggacgacggcgaccugaagcgccugcgggaccucaaccaggccgugaacaaccugguggagcugaaguccacccagcagaaguccguccuccgcguggggacgcugagcuccgacgaccugcucauccuggccgccgaccuggagaagcucaagagcaaggugacccggaccgagcgcccccuguccagcggcgucuacauggggaaccuguccagccagcagcucgaccagcggcgcgcccugcugaacaugaucggcaugaccggcguguccgggggcgggaagggcgcgagcaacgggaucgugcgggucugggacgugaagaacgccgagcuccugaacaaccaguucggcacgaugccgucccugacccucgccugccugaccaagcagggccagguggaccugaacgacgccguccaggcgcucaccgaccuggggcugaucuacacggccaaguaccccaacagcagcgaccucgaccgccugucccagagccaccccauccugaacaugaucgacaccaagaaguccagccucaacaucuccggcuacaacuucagccugggggccgccgugaaggccggcgcgugcaugcuggacggcgggaacaugcucgagaccaucaaggugagcccccagaccauggacggcauccucaagagcauccugaaggucaagaagucccuggggauguucgugagcgacacgccgggcgagcggaaccccuacgagaacauccuguacaagaucugccuguccggggacggcuggagcuacaucgccucccgcaccagcaucgugggccgggccugggagaacaccgucguggaccucgagcaggacaacaagccccagaagaucgggaacggcggguccaacaagagccugcaguccgccggcuucgccgcggggcugaucuacagccagcucaugacccugaaggacuucaagugcuucaaccugauccccaacgccaagacguggauggacaucgagggccgcccggaggaccccguggagaucgcccuguaccagcccuccagcggcugcuacguccacuucuuccgggagcccaccgaccucaagcaguucaagcaggacgccaaguacagccacgggcgcgacgugaccgaccuguucgccgcgcagccgggccugaccuccgccgucaucgaggcccucccccggaacauggugaucacgugccaggggagcgaggacauccgcaagcugcuggagucccagggccgccgggacaucaagcucaucgacaucacccugagcaaggccgacucccgcaaguucgagaacgccgugugggaccaguucaaggaccugugccacaugcacaccggggucgugguggagaagaagaagcggggcggcaaggaggagaucacgccccacugcgcgcucauggacugcaucauguucgacgccgccgucagcgggggccuggacgccaaggugcugcgcgugguccucccccgggacaugguguuccgcaccuccaccccgaaggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6071 - RNA, 1892 nt, Artificial Sequence
  mRNA product Design3 comprising derived and/or modified sequence from Lassa virus__AAF86704__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgaggugaacaacguccagcgccucaugcggaagcagaagcgcgacgacggcgaccugaagcggcugcgcgaccucaaccaggccgugaacaaccugguggagcugaaguccacccagcagaaguccauccuccgggucgggacgcugaccagcgacgaccugcucacccuggccgccgaccuggagaagcucaagagcaaggugauccgcaccgagcggccccuguccagcggcguguacauggggaaccuguccacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccugggccucaucuacaccgcgaaguaccccaacuccagcgaccuggaccgccugucccagagccacccgauccucaacaugguggacaccaagaaguccagccugaacaucagcggguacaacuucucccugggcgccgccgugaaggccggggccugcaugcucgacggcggcaacaugcuggagacgaucaaggucacgccccagaccauggacgggauccucaagagcauccugaaggugaagcggucccugggcauguucgugagcgacacccccggggagcgcaaccccuacgagaacauccuguacaagaucugccucuccggcgacggguggccguacaucgcgagccggaccuccaucgucggccgcgccugggagaacaccaccguggaccuggagagcgacggcaagccccagaagguggggaccgccggcuccaacaagagccugcaguccgccggguuccccacgggccucaccuacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccacggaccugaagcaguucaagcaggacgccaaguacagccacggcaucgacguggccgaccuguucccggcccagcccgggcucaccuccgccgucaucgaggcgcugccccggaacauggugcugaccugccagggcagcgacgacaucaagaagcuccuggacucccaggggcgccgcgacaucaagcugaucgacaucagccucagcaagguggacucccggaaguucgagaacgccgucugggaccagugcaaggaccugugccacaugcacaccggcgugguggucgagaagaagaagcgcgggggcaaggaggagaucacgccccacugcgcccugauggacugcaucauguucgacgccgccgugagcggcgggcucaacaucccggugcugcgggcgguccugccccgcgacaugguguuccggaccuccagccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6072 - RNA, 1892 nt, Artificial Sequence
  mRNA product Design3 comprising derived and/or modified sequence from Lassa virus__AAO59513__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaaggagcgccgggacgacagcgaccugaagcgccugcgggaccucaaccaggccgugaacaaccugguggagcugaaguccacccagcagaaguccguccuccgcgugggcacccugaccagcgacgaccugcucgugcuggccgccgaccuggagaagcuccggagcaaggucacccgcaccgagcggccccuguccgccgggguguacaugggcaaccugagcucccagcagcucgaccagcgccgggcgcugcugagcaugaucgggaugaacggcuccaaccagggcgcccgcgccgggcgggacggcgugguccgcgugugggacgugaagaacgccgagcuccugaacaaccaguucgggaccaugccgagccugacccucgcgugccugaccaagcagggccaggucgaccugaacgacgccgugcaggcccucaccgaccuggggcugaucuacacggccaaguaccccaacaccuccgaccucgaccggcugacccagagccaccccauccugaacaugaucgacaccaagaaguccagccucaacgugagcggcuacaacuucucccugggcgccgcggucaaggccggggccugcaugcuggacggcgggaacaugcucgagacgaucaaggugagcccccagaccauggacggcauccugaaguccauccugaaggugaagaaggcccucggcauguucaucagcgacaccccgggggagcgcaaccccuacgagaacauccuguacaagaucugccuguccggcgacggguggcccuacaucgccagccggaccuccaucacgggccgcgcgugggagaacaccgucguggaccucgagagcgacgagaagccccagaaggccggguccaacaacagcaacaagucccugcagagcgccggcuucaccgccggccugaccuacucccagcucaugacgcugaaggacgccaugcugcagcuggacccgaacgcgaagaccuggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacaucaccgaccuguucgccgcccagcccggccucacguccgcggucaucgacgcccugccccgcaacauggugaucacgugccaggggagcgacgacauccggaagcugcucgagagccagggccgcaaggacaucaagcugaucgacaucgcccugaacaaggccgacucccggaaguacgagaacgcggucugggaccaguacaaggaccucugccacaugcacaccggcgugguggucgagaagaagaagcgcgggggcaaggaggagaucacgccccacugcgcccugauggacugcaucauguucgacgccgccgugagcgggggccugaagacccucgugcugcgggccguccugccgcgcgacaugguguuccggaccuccacgccccgcgugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6073 - RNA, 1892 nt, Artificial Sequence
  mRNA product Design3 comprising derived and/or modified sequence from Lassa virus__AAT48999__NP (opt1)
gggagaaagcuuaccaugagcguguccaaggagaucaagagcuuccuguggacccagucccuccgccgggagcugagcggcuacugcuccaacaucaagcugcaggucgugaaggacgcccaggcccuccugcacgggcuggacuucagcgagguguccaacguccagcgccucaugcggaagcagcgccgggacgacaacgaccugaagcgccugcgggaccucaaccaggcggugaacaaccugguggagcucaagagcacccagcagaaguccguccugcgcgugggcacgcugaccagcgacgaccugcucauccuggccgccgaccuggagaagcucaaguccaaggugacccggaccgagcgcccccugagcgccggggucuacaugggcaaccuguccagccagcagcucgaccagcggcgcgcccugcugaacaugaucgggauguccggcggcaaccagggggcgcagacgggccgggacgggguggugcgcaucugggacgucaagaacgccgagcuccugaacaaccaguucggcaccaugccgagccugacccucgccugccugaccaagcagggccagguggaccugaacgacgugguccaggcccucacggaccuggggcugaucuacaccgcgaaguaccccaacaccuccgaccucgaccggcugacccagagccaccccauccugaacaugaucgacacgaagaaguccagccucaacaucagcggcuacaacuucucccugggggccgccgugaaggccggcgccugcaugcuggacgggggcaacaugcucgagaccaucaaggugagcccccagaccauggacggcauccugaaguccauccugaaggucaagaaggcgcucgggauguucaucagcgacaccccgggcgagcgcaaccccuacgagaacauccuguacaagaucugccuguccggggacggcuggcccuacaucgccagccggacguccaucaccgggcgcgccugggagaacaccgugguggaccucgagagcggcgagaagccccagaagaucggcuccaacaacagcaacaagugccugcaguccgccggguucaccgccggccugagcuacucccagcucaugacgcugaaggacgcgaugcugcagcuggacccgaacgccaagaccuggauggacaucgaggggcggcccgaggaccccgucgagaucgcccucuaccagcccagcuccggcugcuacauccacuucuuccgcgagccgaccgaccugaagcaguucaagcaggacgccaaguacagccacgggaucgacgugaccgaccuguucgccgcgcagcccggccucacguccgccgugaucgaggcccugccccggaacauggucaugaccugccagggcagcgacgacauccgcaagcugcucgagucccaggggcgcaaggacaucaagcugaucgacaucgcccugagcaagaccgacagccggaaguacgagaacgccgugugggaccaguacaaggaccucugccacaugcacaccggcgucgugguggagaagaagaagaagggcgggaaggaggagaucacgccccacugcgcgcugauggacugcaucauguucgacgccgccgucuccgggggccugaacaccagcgugcuccgcgccgugcugccgcgggacauggucuuccgcaccuccacccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6074 - RNA, 1892 nt, Artificial Sequence
  mRNA product Design3 comprising derived and/or modified sequence from Lassa virus__AAT49007__NP (opt1)
gggagaaagcuuaccaugagcguguccaaggagaucaagagcuuccuguggacccagucccuccgccgggagcugagcggcuacugcuccaacaucaagcugcaggucgugaaggacgcccaggcccuccugcacgggcuggacuucagcgagguguccaacguccagcgccucaugcggaagcagcgccgggacgacaacgaccugaagcgccugcgggaccucaaccaggcggugaacaaccugguggagcucaagagcacccagcagaaguccguccugcgcgugggcacgcugaccagcgacgaccugcucauccuggccgccgaccuggagaagcucaaguccaaggugacccggaccgagcgcccccugagcgccgggaucuacaugggcaaccuguccagccagcagcucgaccagcggcgcgcccugcugaacaugaucgggauguccggcggcaaccagggggcgcagacgggccgggacggggucgugcgcaucugggacgugaagaacgccgagcuccugaacaaccaguucggcaccaugccgagccugacccucgccugccugaccaagcaggggcaggucgaccugaacgacguggugcaggcccucacggaccugggccugaucuacaccgcgaaguaccccaacaccuccgaccucgaccggcugacccagagccaccccauccugaacaugaucgacacgaagaaguccagccucaacaucagcggcuacaacuucucccugggggccgccgucaaggccggcgccugcaugcuggacgggggcaacaugcucgagaccaucaaggugagcccccagaccauggacggcauccugaaguccauccugaaggugaagaaggcgcucgggauguucaucagcgacaccccgggcgagcgcaaccccuacgagaacauccuguacaagaucugccuguccggggacggcuggcccuacaucgccagccggacguccaucaccgggcgcgccugggagaacaccgucguggaccucgagagcggcgagaagccccagaagaucggcuccaacaacagcaacaagucccugcagagcgccggguucaccgccggccugacguacucccagcucaugacccugaaggacgcgaugcugcagcuggacccgaacgccaagaccuggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacgucacggaccuguucgccgcgcagcccggccucaccuccgccgugaucgaggcccugccccggaacauggugaugaccugccagggcagcgacgacauccgcaagcugcucgagucccaggggcgcaaggacaucaagcugaucgacaucgcccugagcaagaccgacagccggaaguacgagaacgccgucugggaccaguacaaggaccucugccacaugcacacgggcguggucguggagaagaagaagaagggcgggaaggaggagaucacgccccacugcgcgcugauggacugcaucauguucgacgccgccgccuccgggggccugaacacccucgugcugcgcgcgguccugccgcgggacaugguguuccgcaccagcacccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6075 - RNA, 1892 nt, Artificial Sequence
  mRNA product Design3 comprising derived and/or modified sequence from Lassa virus__AAT49009__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaaguccguccugcgcguggggacccugaacagcgacgaccugcucgugcuggccgccgaccuggagaagcucaaguccaaggucauccggaccgagcgcccccugagcuccggcaucuacauggggaaccugagcucccagcagcucgaccagcggcgcgcccugcugaacaugaucggcaugaccggcgggaaccggggcgggggcaccagcuccgacgggaucgugcgcgugugggacgucaagaacgcggagcuccugaacaaccaguucggcacgaugccgagccugacccucgccugccugaccaagcagggccagguggaccugaacgacgccgugcaggcccucaccgaccuggggcugaucuacacggcgaaguaccccaacuccagcgaccucgaccggcuggcccagagccaccccauccugaacaugaucgacaccaagaaguccagccucaacaucuccggcuacaacuucagccugggggccgccgucaaggccggcgcgugcaugcuggacggcgggaacaugcucgagaccaucaaggugagcccccagaccaucgacggcauccugaagacgauccugaaggugaagaagucccucgggauguucaucagcgacgucccgggcgagcgcaaccccuacgagaacauccuguacaagaucugccugagcggggacggcuggcccuacaucgccucccggaccagcaucgugggccgcgccugggagaacaccguggucgaccucgaguccgacaacaagccccagaagaccgggaacggcgggagcaacaagucccugcagagcgccggcuucgccgcggggcugacguacucccagcucaugacccugaaggacagcaugcugcagcuggacccgaacuccaagaccuggauggacaucgagggccggcccgaggaccccguggagaucgcccucuaccagcccaacagcggcugcuacauccacuucuuccgcgagccgaccgaccugaagcaguucaagcaggacgccaaguacucccacgggaucgacgugacggaccuguucgccgcccagcccggccucaccagcgcggucaucgaggcccugccccggaacauggugaucacgugccaggggagcgaggacauccgcaagcugcucgagucccagggccgccgggacaucaagcugaucgacaucagccugaacaaggccgacucccgcaaguucgagaacgccgucugggaccaguucaaggaccucugccacaugcacaccggggugguggucgagaagaagaagcggggcggcaaggaggagaucacgccccacugcgcccugauggacugcaucauguucgacgcggccgugagcgggggccuggacgccaaggugcuccgcgccguccugccgcgggacaugguguuccgcaccuccacccccaaggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6076 - RNA, 1892 nt, Artificial Sequence
  mRNA product Design3 comprising derived and/or modified sequence from Lassa virus__ADI39452__NP (opt1)
gggagaaagcuuaccaugagcguguccaaggaggucaagagcuuccuguggacccagucccuccgccgggagcugagcggcuacugcuccaacaucaagcuccagguggugaaggacgcccaggcccugcugcacgggcuggacuucagcgaggucuccaacgugcagcgccucaugcggaagcagcgccgggacgacaacgaccugaagcgccugcgggaccucaaccaggcggugaacaaccuggucgagcucaagagcacccagcagaaguccgugcugcgcgugggcacccugaccagcgacgaccugcucauccuggccgccgaccuggagaagcucaagaccaaggucacccggacggagcgcccccuguccgccgggguguacaugggcaaccugagcucccagcagcucgagcagcggcgcgcccugcugaacaugaucgggaugaacggcggcaaccagggggugcaggcgggccgggacggggucgugcgcgugugggacgucaagaacgccgagcuccugaacaaccaguucggcaccaugccgagccugacccucgccugccugaccaagcagggccagguggaccugaacgacgccgugcaggcgcucacggaccuggggcugaucuacaccgccaaguaccccaacaccuccgaccucgaccggcuggcccagagccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccugaaguccauccugaaggugaagcgcacccucgggauguucgucagcgacaccccgggcgagcggaaccccuacgagaacauccuguacaagaucugccuguccggggacggcuggcccuacaucgccagccgcacguccaucaccgggcgggccugggagaacaccaucguggaccucgagagcgacggcaagccccagaaggugggcaacaacggguccaacaagagccugcaguccgccggcuucaccgcggggcugacguacagccagcucaugacccugaaggacgccaugcugcagcuggacccgaacgccaagaccuggauggacaucgagggccgccccgaggaccccgucgagguggcccucuaccagcccuccagcgggugcuacauccacuucuuccgggagccgaccgaccugaagcaguucaagcaggacgccaaguacucccacggcaucgacgucacggaccuguucgcggcccagcccggccucaccagcgccgugaucgaggcccugccccgcaacauggugaucacgugccagggguccgaggacguccgcaagcugcucgagagccagggccggaaggacaucaagcugaucgacaucgcccuguccaaggcggacagccgcaaguacgagaacgccgugugggaccaguacaaggaccucugccacaugcacaccgggguggucguggagaagaagaagcggggcgggaaggaggagaugacgccccacugcgcccugauggacugcaucauguucgacgccgcgguguccggcggccugagcacccagguccuccgcgccgugcugccgcgggacaugguguuccgcaccagcacccccaaggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6077 - RNA, 1892 nt, Artificial Sequence
  mRNA product Design3 comprising derived and/or modified sequence from Lassa virus__ADU56611__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugaccagcgacgaccugcucacccuggccgccgaccuggagaagcucaaguccaaggugauccgcaccgagcggccccugagcuccggcgucuacauggggaaccugagcacgcagcagcucgagcagcgcaaggcccugcuguccaugaucggcauggugggcggggcgcagggcacccagccggggcgggacggcgugguccgcgugugggacgugaagaaccccgaccuccugaacaaccaguucgggaccaugcccagccugacccucgccugccugacgaagcagggccaggucgaccugaacgacgccgugcucgcccugaccgaccugggccucaucuacaccgcgaaguaccccaacuccagcgaccuggaccggcugucccagagccacccgauccucaacaugguggacaccaagaaguccagccugaacaucagcggguacaacuucucccugggcgccgccgucaaggccggggccugcaugcucgacggcggcaacaugcuggagacgaucaaggugacgccccagaccauggacgggauccucaagagcauccugaaggugaagcgcucccugggcauguucgucagcgacacccccggggagcggaaccccuacgagaacauccuguacaagaucugccucuccggcgacggguggccguacaucgcgagccgcaccuccaucgugggccgggccugggagaacaccaccguggaccuggagagcgacggcaagccccagaaggucgggaccgccggcuccaacaagagccugcaguccgccggguuccccacgggccucaccuacagccagcugaugacccugaaggacuccaugaugcagcuggaccccagcgccaagaccuggaucgacaucgaggggcgcccggaggaccccguggagaucgcgcucuaccagcccauguccggcugcuacauccacuucuuccgggagcccacggaccugaagcaguucaagcaggacgccaaguacagccacggcaucgacgucaccgaccuguucuccgcccagccggggcucaccagcgccgugaucgaggcccugccccgcaacauggugcugaccugccagggcagcgacgacaucaagaagcuccuggacucccaggggcggcgcgacaucaagcugaucgacaucagccucaacaaggcggacucccgccgguucgagaacgccgucugggaccagugcaaggaccugugccacaugcacacgggcgugguggucgagaagaagaagcgcgggggcaaggaggagaucacgccccacugcgcccugauggacugcaucauguucgacgccgccgugagcggcgggcucaacauccccauccugcgggcggugcugccgcgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6078 - RNA, 1892 nt, Artificial Sequence
  mRNA product Design3 comprising derived and/or modified sequence from Lassa virus__ADU56615__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccggaucggcacccugagcagcgacgaccugcucauccuggccgccgaccuggagaagcucaaguccaagguggugcgcaccgagcggccccugagcuccgggaucuacaugggcaaccugagcucccagcagcucgaccagcgcaaggcccugcugaacaugaucgggaugaccggcggcaacgggggccggaacgcgaccagcgacgggaucguccgcgugugggacgugaagaacgccgagcuccugaacaaccaguucggcacgaugccgucccugacccucgccugccugaccaagcaggggcaggucgaccugaacgacgccgugcaggcgcucaccgaccugggccugaucuacacggccaaguaccccaacagcagcgaccucgaccggcuggcccagucccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagaccauggacggcauccugaaguccauccugaaggugaagcgcagccucgggauguucaucuccgacacgccgggcgagcggaaccccuacgagaacauccuguacaagaucugccugagcggggacggcuggcccuacaucgccucccgcaccagcaucguggggcgggccugggagaacaccgucguggaccucgagaccgacaacaagccccagaagacgggcaacggcggguccaacaagagccugcaguccgccggcuucgcggccgggcugaccuacagccagcucaugacccugaaggacuccaugcugcagcuggacccgaacgccaagaccuggauggacaucgagggccgccccgaggaccccguggagaucgcccucuaccagcccgucagcgggugcuacauccacuucuuccgggagccgacggaccugaagcaguucaagcaggacgccaaguacucccacggcaucgacgugaccgaccuguucgcggcccagcccggccucaccagcgccgugaucgaggcccugccccgcaacauggucaucacgugccaggggagcgaggacauccggaagcugcucgagucccagggccgccgcgacaucaagcugaucgacaucagccuguccaagguggacagccggaaguucgagaacgccgucugggaccaguucaaggaccucugccacaugcacaccgggaucgugguggagaagaagaagcgcggcgggaaggaggagaucacgccccacugcgcgcugauggacugcaucauguucgacgccgccgucuccggcggcguggacgccaaggugcugcgggcgguccucccgcgcgacaugguguuccggaccagcacccccaaggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6079 - RNA, 1892 nt, Artificial Sequence
  mRNA product Design3 comprising derived and/or modified sequence from Lassa virus__ADU56619__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugagcuccgacgaccugcucgugcuggccgccgaccuggagaagcucaagagcaaggucgugcgcaccgagcggccccuguccagcggcaucuacauggggaaccuguccagccagcagcucgaccagcgcaaggcccugcugaacaugaucggcaugaccggcgggaacggcgggcggaacaccacguccgacggcaucgugcgcgucugggacgugaagaacgcggagcuccugaacaaccaguucgggaccaugccgagccugacccucgccugccugaccaagcagggccagguggaccugaacgacgccguccaggcccucacggaccugggccugaucuacaccgcgaaguaccccaacuccagcgaccucgaccggcuggcccagagccaccccauccugaacaugaucgacaccaagaaguccagccucaacaucuccggguacaacuucagccugggcgccgccgugaaggccggggcgugcaugcuggacggcggcaacaugcucgagaccaucaaggugagcccccagacgauggacgggauccucaagagcauccugaaggucaagcgcucccugggcauguucaucagcgacaccccgggggagcggaaccccuacgagaacauccuguacaagaucugccuguccggcgacggguggcccuacaucgccagccgcaccuccaucgugggccgggccugggagaacaccguggucgaccucgagagcgacaacaagccccagaagacgggcaacgggggcuccaacaagagccugcaguccgccggguucgccgcgggccugaccuacagccagcucaugacccugaaggacuccaugcugcagcuggacccgaacgccaagaccuggauggacaucgaggggcgccccgaggaccccguggagaucgcccucuaccagcccagcuccggcugcuacauccacuucuuccgggagccgacggaccugaagcaguucaagcaggacgccaaguacagccacggcaucgacgugaccgaccuguucgccgcgcagcccgggcucaccagcgccgucaucgaggcccugccccgcaacauggugaucacgugccagggcuccgaggacauccggaagcugcucgagagccaggggcgccgcgacaucaagcugaucgacaucucccugagcaaggucgacucccggaaguucgagaacgccgugugggaccaguucaaggaccucugccacaugcacaccggcaucguggucgagaagaagaagcgcgggggcaaggaggagaucacgccccacugcgcccugauggacugcaucauguucgacgcggccgugagcggcgggguggacgccaagguccugcgggccgugcucccgcgcgacaugguguuccggaccuccacccccaaggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6080 - RNA, 1892 nt, Artificial Sequence
  mRNA product Design3 comprising derived and/or modified sequence from Lassa virus__ADU56623__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccgucgagaucgcgcuguaccagcccauguccgggugcuacauccacuucuuccgggagcccacggaccugaagcaguucaagcaggacgccaaguacagccacggcaucgacguggccgaccucuucccggcccagcccggccugaccuccgccgucaucgaggcgcugccccgcaacauggugcugaccugccaggggagcgacgacaucaagcggcuccuggacagccagggccgccgcgacaucaagcucaucgacaucgcccuguccaaggccgacagccggcgcuucgagaacgccgugugggaccagugcaaggaccugugccacaugcacaccggggucgugguggagaagaagaagcggggcgggaaggaggagaucacgccccacugcgcccucauggacugcaucauguacgacgcggccgucuccggcggccugaacaucccggugcugcgcgccgugcucccccgggacauggucuuccgcaccagcucccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6081 - RNA, 1892 nt, Artificial Sequence
  mRNA product Design3 comprising derived and/or modified sequence from Lassa virus__ADU56627__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccugaacacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagucccacccgauccucaacauggucgacaccaagaaguccagccugaacaucagcggcuacaacuucagccugggggccgccgugaaggccggcgcgugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggccugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgcgaagaccuggaucgacaucgagggccgcccggaggaccccguggagaucgcccucuaccagcccaugagcgggugcuacauccacuucuuccgggagcccacggaccugaagcaguucaagcaggacgccaaguacucccacggcaucgacgucgccgaccuguucccggcccagcccggccucaccagcgcggugaucgaggcccugccccgcaacaugguccugaccugccagggguccgacgacaucaagcggcuccuggacagccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6082 - RNA, 1892 nt, Artificial Sequence
  mRNA product Design3 comprising derived and/or modified sequence from Lassa virus__ADU56631__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacgugaccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6083 - RNA, 1892 nt, Artificial Sequence
  mRNA product Design3 comprising derived and/or modified sequence from Lassa virus__AFY05580__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccggcggcaagccccagaaggccgacagcaacaacuccagcaagucccugcagagcgccggguucaccgccggccugaccuacucccagcucaugacccugaaggacgccaugcugcagcuggacccgaacgcgaagacguggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacgugaccgaccuguucgccacccagcccggccucacguccgccgucaucgacgcgcugccccgcaacauggugaucacgugccagggcagcgacgacauccggaagcugcucgagagccaggggcgcaaggacaucaagcugaucgacaucgaccuguccaagaccgacagccggaaguacgagaacgccgugugggaccaguacaaggaccucugccacaugcacaccggcgucguggucgagaagaagaagcgcgggggcaaggaggagaucaccccgcacugcgcccugauggacugcaucauguucgacgccgcgguguccgggggccugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6084 - RNA, 1892 nt, Artificial Sequence
  mRNA product Design3 comprising derived and/or modified sequence from Lassa virus__AFY05581__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccggcggcaagccccagaaggccgacagcaacaacuccagcaagucccugcagagcgccggguucaccgccggccugaccuacucccagcucaugacccugaaggacgccaugcugcagcuggacccgaacgcgaagacguggauggacaucgaggggcgccccgaggaccccguggagaucgcccucuaccagcccagcuccggcugcuacauccacuucuuccgggagccgaccgaccugaagcaguucaagcaggacgccaaguacagccacgggaucgacgugaccgaccuguucgccacccagcccggccucacguccgccgucaucgacgcgcugccccgcaacauggugaucacgugccagggcagcgacgacauccgcaagcugcucgagagccaggggcggaaggacaucaagcugaucgacaucgaccuguccaagaccgacagccgcaaguacgagaacgccgugugggaccaguacaaggaccucugccacaugcacaccggcgucguggucgagaagaagaagcgcgggggcaaggaggagaucaccccgcacugcgcccugauggacugcaucauguucgacgccgcgguguccgggggccugaacaccagcgugcucaaggccguccugccccgggacaugguguuccggaccuccacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6085 - RNA, 1892 nt, Artificial Sequence
  mRNA product Design3 comprising derived and/or modified sequence from Lassa virus__AFY05587__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6086 - RNA, 1892 nt, Artificial Sequence
  mRNA product Design3 comprising derived and/or modified sequence from Lassa virus__AFY05591__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgucgagcuccugagcaaccaguucggcaccaugccgucccugacgcucgccugccugaccaagcagggccagguggaccugaacgacgcggugcaggcccucaccgaccuggggcugaucuacaccgccaaguaccccaacacgagcgaccucgaccgccuggcccagucccaccccauccugaacaugaucgacaccaagaaguccagccucaacaucuccggcuacaacuucagccugggggccgcggucaaggccggcgccugcaugcuggacgggggcaacaugcucgagaccaucaaggugagcccccagaccauggacggcauccucaagagcauccugaaggugaagaaggcccuggggauguucaucuccgacacgccgggcgagcggaaccccuacgagaacauccuguacaagaucugccugagcggggacggcuggcccuacaucgccucccgcaccagcaucaccgggcgggcgugggagaacaccgucguggaccucgaguccgacggcaagccccagaaggccgacagcaacaacuccagcaagucccugcagagcgccggcuucacggccgggcugaccuacucccagcucaugacccugaaggacgccaugcugcagcuggacccgaacgcgaagaccuggauggacaucgagggccgccccgaggaccccguggagaucgcccucuaccagcccagcuccgggugcuacauccacuucuuccgggagccgacggaccugaagcaguucaagcaggacgccaaguacagccacggcaucgacgucaccgaccuguucgccacccagcccgggcucaccuccgccgugaucgacgcgcugccccgcaacauggugaucacgugccagggcagcgacgacauccgcaagcugcucgagagccagggccggaaggacaucaagcugaucgacaucgaccuguccaagaccgacagccgcaaguacgagaacgccgucugggaccaguacaaggaccucugccacaugcacaccgggguggucguggagaagaagaagcggggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6087 - RNA, 1892 nt, Artificial Sequence
  mRNA product Design3 comprising derived and/or modified sequence from Lassa virus__AFY05597__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccgcaagcugcucgagagccagggccggaaggacaucaagcugaucgacaucgaccuguccaagaccgacagccgcaaguacgagaacgccgugugggaccaguacaaggaccucugccacaugcacaccggggucguggucgagaagaagaagcggggcgggaaggaggagaucaccccgcacugcgcccugauggacugcaucauguucgacgccgcgguguccggcgggcugaacaccagcgugcuccgcgccguccugccccgggacaugguguuccgcaccuccacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6088 - RNA, 1892 nt, Artificial Sequence
  mRNA product Design3 comprising derived and/or modified sequence from Lassa virus__AFY05610__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacgcugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacacgaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgugaccgaccuguucgccacgcagcccgggcucaccuccgccgucaucgacgcccugccccgcaacauggugaucacgugccagggcagcgacgacauccgcaagcugcucgagagccagggccggaaggacaucaagcugaucgacaucgaccuguccaagaccgacagccgcaaguacgagaacgcggugugggaccaguacaaggaccucugccacaugcacaccggggucguggucgagaagaagaagcggggcgggaaggaggagaucaccccgcacugcgcccugauggacugcaucauguucgacgccgccguguccggcgggcugaacaccagcgugcuccgcgcgguccugccccgggacaugguguuccgcaccuccacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6089 - RNA, 1892 nt, Artificial Sequence
  mRNA product Design3 comprising derived and/or modified sequence from Lassa virus__AFY05616__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccuggcccagucccaccccauccugaacaugaucgacaccaagaaguccagccucaacaucuccggcuacaacuucagccugggggcggccgugaaggccggcgccugcaugcuggacgggggcaacaugcucgagaccaucaaggucagcccccagaccauggacggcauccucaagagcauccugaaggugaagaaggcccuggggauguucaucuccgacacgccgggcgagcggaaccccuacgagaacauccuguacaagaucugccugagcggggacggcuggcccuacaucgcgucccgcaccagcaucaccgggcgggccugggagaacaccguggucgaccucgaguccgacggcaagccccagaaggccgacagcaacaacuccagcaagucccugcagagcgccggcuucacggccgggcugaccuacucccagcucaugacccugaaggacgcgaugcugcagcuggacccgaacgccaagaccuggauggacaucgagggccgccccgaggaccccguggagaucgcccucuaccagcccagcuccgggugcuacauccacuucuuccgggagccgacggaccugaagcaguucaagcaggacgccaaguacagccacggcaucgacgugaccgaccuguucgccacccagcccgggcucaccuccgcggucaucgacgcccugccccgcaacauggugaucacgugccagggcagcgacgacauccgcaagcugcucgagagccagggccggaaggacaucaagcugaucgacaucgaccuguccaagaccgacagccgcaaguacgagaacgccgugugggaccaguacaaggaccucugccacaugcacaccggggucguggucgagaagaagaagcggggcgggaaggaggagaucacgccccacugcgcccugauggacugcaucauguucgacgcggccguguccggcgggcugaacaccagcgugcuccgcgccguccugccgcgggacaugguguuccgcaccuccacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6090 - RNA, 1898 nt, Artificial Sequence
  mRNA product Design3 comprising derived and/or modified sequence from Lassa virus__AFY05618__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcagaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6091 - RNA, 1892 nt, Artificial Sequence
  mRNA product Design3 comprising derived and/or modified sequence from Lassa virus__AHC95552__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacccugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcaugacgggcgggaaccagggcacccaggcggggcgggacggcguggugcgcgucugggacgugaagaacgccgagcuccugaacaaccaguucgggaccaugccgucccugacccucgccugccugacgaagcagggccaggccgaccugaacgacgugguccaggcgcucaccgaccugggccugaucuacaccgccaaguaccccaacgccagcgaccucgaccggcugacccagucccaccccauccugaacaugaucgacacgaagaaguccagccucaacaucagcggguacaacuucagccugggcgccgccgugaaggcgggggccugcaugcuggacggcggcaacaugcucgagaccaucaaggugagcccccagagcauggacgggauccugaaguccauccugaaggucaagcgcgcccucggcauguucgugagcgacaccccgggggagcggaaccccuacgagaacauccuguacaagaucugccuguccggcgacggguggcccuacaucgccagccgcaccuccaucgugggccgggccugggagaacacggucguggaccucgaggcggacggcaaccccaagaagcugaacagcaacggguccaacaagagccugcaguccgccggcuucccggccgggcucaccuacagccagcugaugacccugaaggacgccaugcugcagcucgaccccaacgccaagaccuggauggacaucgagggccgccccgaggaccccguggaggucgcgcuguaccagccgaacuccgggugcuacauccacuucuuccgggagcccacggaccugaagcaguucaagcaggacgccaaguacagccacggcaucgacgugaccgaccucuucgccgcccagcccggccugaccuccgccgucaucgaggcgcugccccgcaacauggugaucacgugccaggggagcgaggacauccgcaagcuccuggagucccagggccggaaggacaucaagcugaucgacaucgcccucagcaagaccgacucccgcaaguucgagaacgccgugugggaccaguacaaggaccugugccacaugcacaccggggucgugguggagaagaagaagcggggcgggaaggaggagaucaccccgcacugcgcccugauggacugcaucauguucgacgcggccgucagcggcggccucaacacccuggugcugcgcgccgugcucccccgggacauggucuuccgcacgagcacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6092 - RNA, 1892 nt, Artificial Sequence
  mRNA product Design3 comprising derived and/or modified sequence from Lassa virus__AHC95554__NP (opt1)
gggagaaagcuuaccaugagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagcggcgcgacgacggcgaccugaagcggcugcgcgaccucaaccaggccgugaacaaccugguggagcucaagagcacccagcagaaguccguccugcggguggggacccugaacagcgacgaccugcucacccuggccgccgaccuggagaagcucaaguccaaggugacccgcaccgagcggccccugagcuccggcgucuacauggggaaccugagcucccagcagcucgaccagcgccgggcccugcugaacaugaucggcaugacgggcgggaaccagggcgcgcaggccgggcgcgacggcguggugcgggucugggacgugaagaacgccgagcuccugaacaaccaguucgggaccaugccgagccugacccucgccugccugaccaagcagggccagguggaccugaacgacgucgugcaggcgcucacggaccugggccugaucuacaccgccaaguaccccaacaccuccgaccucgaccgccugacccagagccaccccauccugaacaugaucgacacgaagaaguccagccucaacaucagcggguacaacuucucccugggcgccgccgugaaggccggggcgugcaugcuggacggcggcaacaugcucgagaccaucaagaucagcccccaguccgucgacgggauccucaagagcauccugaaggugaagcggucccugggcauguucgugagcgacaccccgggggagcgcaaccccuacgagaacauccuguacaagaucugccuguccggcgacggguggcccuacaucgccagccggaccuccaucgucggccgcgccugggagaacacggugguggaccucgaggccgacggcaagccccagaagccgaacagcggguccagcaacaagucccugcagagcgccggcuuccccgcggggcugaccuacucccagcucaugacccugaaggacgccaugcugcagcuggaccccaacgccaagaccuggauggacaucgagggccggcccgaggacccggucgagguggcccucuaccagcccagcuccgggugcuacauccacuucuuccgcgagcccacggaccugaagcaguucaagcaggacgccaaguacagccacggcaucgacgucaccgaccuguucgcggcccagcccggccucaccuccgccgugaucgaggcccugccgcgcaacauggugaucacgugccaggggagcgaggacaucaagaagcugcucgagagccagggccggaaggacaucaagcugaucgacaucgcccuguccaagaucgacagccgcaaguucgagaacgcggucugggaccaguacaaggaccucugccacaugcacaccggggugguggucgagaagaagaagcggggcgggaaggaggagaucacgccccacugcgcccugauggacugcaucauguucgacgccgccguguccggcggccugaacgcgagcgugcuccgcgccguccugccccgggacaugguguuccgcaccuccacccccaaggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6093 - RNA, 1892 nt, Artificial Sequence
  mRNA product Design3 comprising derived and/or modified sequence from Lassa virus__AHC95556__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacgcugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcaugacgggcgggaaccagggcacccagaccgggcgggacggcguggugcgcgucugggacgugaagaacgcggagcuccugaacaaccaguucgggaccaugccgucccugacgcucgccugccugaccaagcagggccaggccgaccugaacgacgugguccaggcccucaccgaccugggccugaucuacaccgcgaaguaccccaacgccagcgaccucgaccggcugacgcagucccaccccauccugaacaugaucgacaccaagaaguccagccucaacaucagcggguacaacuucagccugggcgccgccgugaaggccggggcgugcaugcuggacggcggcaacaugcucgagaccaucaaggugagcccccagagcauggacgggauccugaaguccauccugaaggucaagcgcgcccucggcauguucgugagcgacaccccgggggagcggaaccccuacgagaacauccuguacaagaucugccuguccggcgacggguggcccuacaucgccagccgcacguccaucgugggccgggccugggagaacaccgucguggaccucgaggccgacggcaaccccaagaagcugaacagcaacggguccaacaagagccugcaguccgcgggcuucccggccgggcucaccuacagccagcugaugacccugaaggacgccaugcugcagcucgaccccaacgccaagacguggauggacaucgagggccgccccgaggaccccguggaggucgcccuguaccagccgaacuccgggugcuacauccacuucuuccgggagcccaccgaccugaagcaguucaagcaggacgcgaaguacagccacggcaucgacgugaccgaccucuucgccgcccagcccggccugaccuccgccgucaucgaggcccugccccgcaacauggugaucacgugccaggggagcgaggacauccgcaagcuccuggagucccagggccggaaggacaucaagcugaucgacaucgcgcucagcaagaccgacucccgcaaguucgagaacgccgugugggaccagcacaaggaccugugccacaugcacaccggggucgugguggagaagaagaagcggggcgggaaggaggagaucaccccgcacugcgcccugauggacugcaucauguucgacgccgcggucagcggcggccucaacacgcuggugcugcgcgccgugcucccccgggacauggucuuccgcaccagcacccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6094 - RNA, 1892 nt, Artificial Sequence
  mRNA product Design3 comprising derived and/or modified sequence from Lassa virus__AHC95558__NP (opt1)
gggagaaagcuuaccaugagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagcggcgcgacgacagcgaccugaagcggcugcgcgaccucaaccaggccgugaacaaccugguggagcugaaguccacccagcagaaguccguccuccgggugggcacgcuguccagcgacgaccugcucacccuggccgccgaccuggagaagcucaaguccaaggugauccgcaccgagcggccccugagcuccggggucuacaugggcaaccugagcucccagcagcucgaccagcgccgggcccugcugaacaugaucgggaugaccggcggcaaccagggggcgcaggccggccgcgacgggguggugcgggucugggacgugcgcaacgccgagcuccugaacaaccaguucggcacgaugccgagccugacccucgccugccugaccaagcagggccagguggaccugaacgacgucgugcaggcgcucaccgaccuggggcugaucuacacggccaaguaccccaacaccuccgaccucgaccggcugacccagaaccaccccauccugaacaugaucgacaccaagaaguccagccucaacaucagcggcuacaacuucagccugggggccgccgugaaggccggcgcgugcaugcuggacgggggcaacaugcucgagacgaucaaggucagcccccagagcaucgacggcauccugaaguccauccugaaggugaagcgcacccucgggauguucgugagcgacaccccgggcgagcggaaccccuacgagaacauccuguacaagaucugccuguccggggacggcuggcccuacaucgccagccgcaccuccaucgucgggcgggccugggagaacacggugguggaccucgagaccgaccgcaagagccagggccccaacuccggcaacagcaacaagucccugcagagcgccggguucuccgccggccugaccuacagccagcucaugacccugaaggacgcgaugcugcagcuggacccgaacgccaagacguggauggacaucgaggggcgccccgaggaccccgucgagguggcccucuaccagcccaucuccggcugcuacauccacuucuuccgggagccgaccgaccugaagcaguucaagcaggacgccaaguacagccacgggaucgacaucaccgaccuguucgccgcgcagcccggccucaccuccgccgucaucgaggcccugccccgcaacauggugaucacgugccagggcagcgaggacaucaagaagcugcucgagagccaggggcggaaggacaucaagcugaucgacaucgcccuguccaagaucgacagccgcaaguucgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaacgccagcgugcuccgggcggugcugccgcgggacauggucuuccgcaccuccacccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6095 - RNA, 1892 nt, Artificial Sequence
  mRNA product Design3 comprising derived and/or modified sequence from Lassa virus__AHC95560__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacgcugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcauguccggcgggaaccagggcacccagguggggcgggacggcgugguccgcgugugggacgugaagaacgcggagcuccugaacaaccaguucgggaccaugccgagccugacccucgccugccugaccaagcagggccaggccgaccugaacgacgucgugcaggcccucacggaccugggccugaucuacaccgcgaaguaccccaacgccuccgaccucgaccggcugacccagagccaccccauccugaacaugaucgacaccaagaaguccagccucaacaucagcggguacaacuucucccugggcgccgccgugaaggccggggcgugcaugcuggacggcggcaacaugcucgagacgaucaaggucagcccccaguccauggacgggauccucaagagcauccugaaggugaagcgcgcccugggcauguucguguccgacaccccgggggagcggaaccccuacgagaacauccuguacaagaucugccugagcggcgacggguggcccuacaucgccucccgcaccagcaucgucggccgggccugggagaacaccgugguggaccucgaggccgacggcaaccccaagaagcugaacuccaacgggagcaacaagucccugcagagcgcgggcuucccggccgggcucacguacucccagcugaugacccugaaggacgccaugcugcagcucgaccccaacgccaagaccuggauggacaucgagggccgccccgaggaccccgucgagguggcccuguaccagccgaacagcgggugcuacauccacuucuuccgggagcccaccgaccugaagcaguucaagcaggacgcgaaguacucccacggcaucgacgucacggaccucuucgccgcccagcccggccugaccagcgccgugaucgaggcccugccccgcaacauggugaucacgugccagggguccgaggacauccgcaagcuccuggagagccagggccggaaggacaucaagcugaucgacaucgcgcucuccaagaccgacagccgcaaguucgagaacgccgucugggaccagcacaaggaccugugccacaugcacacgggggugguggucgagaagaagaagcggggcgggaaggaggagaucaccccgcacugcgcccugauggacugcaucauguucgacgccgcggugagcggcggccucaacacccuggugcugcgcgccguccucccccgggacaugguguuccgcaccuccacgcccaaggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6096 - RNA, 1892 nt, Artificial Sequence
  mRNA product Design3 comprising derived and/or modified sequence from Lassa virus__AIT17127__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcaaccagggggugcgggccggcaaggacggggucgugcgcgugugggacgucaagaacgccgagcuccugaacaaccaguucggcaccaugccgucccugacgcucgccugccugaccaagcagggccagguggaccugaacgacgcggugcaggcccucaccgaccuggggcugaucuacaccgccaaguaccccaacacgagcgaccucgaccggcugacccagucccaccccauccugaacaugaucgacaccaagaaguccagccucaacaucuccggcuacaacuucagccugggggccgccgucaaggcgggcgccugcaugcuggacgggggcaacaugcucgagaccaucaaggugagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgccugggagaacacggucguggaccucgaguccgacggcaagccccagaaggcgggcagcaacaacuccaacaagagccugcaguccgccggguucaccgccggccugaccuacagccagcucaugacccugaaggacgccaugcugcagcuggacccgaacacgaagaccuggauggacaucgaggggcggcccgaggaccccguggagaucgcccucuaccagcccuccagcggcugcuacauccacuucuuccgcgagccgaccgaccugaagcaguucaagcaggacgcgaaguacucccacgggaucgacgucaccgaccuguucgccgcccagcccggccucacgagcgccgugaucgacgcccugccccggaacauggugaucacgugccagggcuccgacgacauccgcaagcugcucgagagccaggggcgcaaggacaucaagcugaucgacaucgcgcugaacaagaccgacagccggaaguacgagaacgccgucugggaccaguacaaggaccucugccacaugcacaccggcguggucguggagaagaagaagcgcgggggcaaggaggagaucaccccgcacugcgcccugauggacugcaucauguucgacgccgcgguguccgggggccugaacaccagcguccuccgggccgugcugccccgcgacaugguguuccggaccuccacgccccgcgucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6097 - RNA, 1892 nt, Artificial Sequence
  mRNA product Design3 comprising derived and/or modified sequence from Lassa virus__AIT17131__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacgcugagcuccgacgaccugcucguccuggccgccgaccuggagaagcucaagagcaaggugacccggaccgagcgcccccuguccgccgggguguacaugggcaaccugagcucccagcagcucgaccagcggcgcgcgcugcugaacaugaucgggaugagcggcggcaaccagggggcccgggccggccgcgacggggucgugcgggugugggacgucaagaacgccgagcuccugaacaaccaguucggcaccaugccgucccugacgcucgcgugccugaccaagcagggccagguggaccugaacgacgugguccaggcccucaccgaccuggggcugaucuacaccgccaaguaccccaacacgagcgaccucgaccgccugacccagucccaccccauccugaacaugguggacaccaagaaguccagccucaacaucuccggcuacaacuucagccugggggccgccgugaaggcgggcgccugcaugcuggacgggggcaacaugcucgagaccaucaaggucagcccccagacgaucgacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggccugggagaacacgguggucgaccucgaguccgacggcaagccccagaaggcgggcagcaacaacuccaacaagagccugcaguccgccggguucaccgccggccugaccuacagccagcucaugacccugaaggacgccaugcugcagcuggacccgaacgccaagaucuggauggacaucgaggggcgccccgaggaccccguggagaucgcgcucuaccagcccuccagcggcugcuacauccacuucuuccgggagccgacggaccugaagcaguucaagcaggacgccaaguacucccacgggaucgacgugaccgaccuguucgccgcccagcccggccucaccagcgccgucaucgacgcgcugccccgcaacauggugaucacgugccagggcgccgacgacauccgcaagcugcucgagucccaggggcggaaggacaucaagcugaucgacaucgcccugaacaaggccgacagccgcaaguacgagaacgcggucugggaccaguacaaggaccucugccacaugcacaccggcgugguggucgagaagaagaagcgcgggggcaaggaggagaucaccccgcacugcgcccugauggacugcaucauguucgacgccgccgugagcgggggccugaacaccuccgugcuccgggccguccugccccgggacaugguguuccgcaccagcacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6098 - RNA, 1892 nt, Artificial Sequence
  mRNA product Design3 comprising derived and/or modified sequence from Lassa virus__AIT17139__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggaucguggucgagaagaagaagcggggcgggaaggaggagaucacgccccacugcgcccugauggacugcaucauguucgacgccgccgugagcggcgggcugaacaccuccgugcuccgcgccguccugccgcgggacaugguguuccgcaccaccacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6099 - RNA, 1892 nt, Artificial Sequence
  mRNA product Design3 comprising derived and/or modified sequence from Lassa virus__AIT17143__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcaacaacggcagcaacaagucccugcagagcgccggguucaccgccggccugaccuacucccagcucaugacgcugaaggacgccaugcugcagcuggacccgaacgcgaagaccuggauggacaucgaggggcgccccgaggaccccguggagaucgcccucuaccagcccagcuccggcugcuacauccacuucuuccgggagccgaccgaccugaagcaguucaagcaggacgccaaguacagccacgggaucgacgugaccgaccuguucgccgcccagcccggccucacguccgcggucaucgacgcccugccccgcaaccuggugaucacgugccagggcagcgacgacauccgcaagcuccuggagucccaggggcggaaggacaucaagcugaucgacaucgcccucagcaagaccgacagccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucuccgggggccucaacaccagcgugcugcgggccgugcugccccgggacauggucuuccgcaccuccacgccccggguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6100 - RNA, 1892 nt, Artificial Sequence
  mRNA product Design3 comprising derived and/or modified sequence from Lassa virus__AIT17147__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgagcagcggcgcgcgcugcugaacaugaucgggauguccggcagcaaccagggcgcccaggccgggcgggacggcgucgugcgcgugugggacgucaagaacgccgagcuccugaacaaccaguucgggacgaugccgucccugacccucgcgugccugaccaagcagggccagguggaccugaacgacgccgugcaggcccucaccgaccuggggcugaucuacacggucaaguaccccaacaccagcgaccucgaccggcugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgacaccccgggggagcgcaaccccuacgagaacauccuguacaagaucugccugagcggcgacggguggcccuacaucgccucccggaccagcaucacgggccgcgccugggagaacaccgugguggaccucgaguccgacgggaagccccagaaggcggacagcaacuccagcaacaagucccugcagagcgccggcuucaccgccggccugaccuacucccagcucaugacgcugaaggacgccaugcugcagcuggacccgaacgccaagaccuggauggacaucgaggggcggcccgaggaccccgucgagguggcgcucuaccagcccagcuccggcugcuacauccacuucuuccgcgagccgaccgaccugaagcaguucaagcaggacgccaaguacagccacgggaucgacgugaccgaccuguucgccgcccagcccggccucacguccgccgucaucgacgcgcugccccggaacauggugaucacgugccaggggagcgacgacauccgcaagcugcucgagagccagggccgcaaggacaucaagcugaucgacaucgcccuguccaagaccgacagccggaaguacgagaacgccgucugggaccaguacaaggaccucugccacaugcacaccggcgugguggucgagaagaagaagcgcgggggcaaggaggagaucaccccgcacugcgcccugauggacugcaucauguucgacgcggccguguccgggggccugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6101 - RNA, 1892 nt, Artificial Sequence
  mRNA product Design3 comprising derived and/or modified sequence from Lassa virus__AIT17151__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacguggugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagcugcagaaggcgggcagcaacaacuccaacaagagccugcaguccgccggguucaccgccggccucaccuacagccagcugaugacgcugaaggacgccaugcugcagcucgaccccaacgccaagaccuggauggacaucgaggggcgcccggaggaccccguggagaucgcgcuguaccagcccuccagcggcugcuacauccacuucuuccgggagcccaccgaccugaagcaguucaagcaggacgccaaguacucccacgggaucgacgucaccgaccucuucgccgcccagccgggccugacgagcgccgugaucgacgcgcugccccgcaacauggugaucacgugccagggcuccgacgacauccgcaagcuccuggagagccaggggcggaaggacaucaagcugaucgacaucgcccucaacaagaccgacagccgcaaguacgagaacgccgucugggaccaguacaaggaccugugccacaugcacaccggcguggucguggagaagaagaagaagggcgggaaggaggagaucacgccccacugcgcccugauggacugcaucauguucgacgcggccguguccgggggccucaacaccagcguccugcgggccgugcugccccgcgacaugguguuccggaccuccaccccgcgcgucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6102 - RNA, 1892 nt, Artificial Sequence
  mRNA product Design3 comprising derived and/or modified sequence from Lassa virus__AIT17155__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgagcugcucgugcuggccgccgaccuggagaagcucaaguccaaggugauccggaccgagcgcccccugagcgccggggucuacaugggcaaccuguccagccagcagcucgaccagcggcgcgcgcugcuguccaugaucgggaugagcggcggcaaccagggggcccggaccggccgcgacgggguggugcgggucugggacgugaagaacgccgagcuccugaacaaccaguucggcaccaugccgucccugacccucgccugccugaccaagcagggccagguggaccugaacgacgcgguccaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggggccgccgugaaggcgggcgccugcaugcuggacgggggcaacaugcucgagacgaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgugguggaccucgaguccgacggcaagccccagaaggcgggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccgucgagaucgcgcucuaccagcccuccagcggcugcuacauccacuucuuccgggagccgaccgaccugaagcaguucaagcaggacgccaaguacucccacgggaucgacgugaccgaccuguucgccgcccagcccggccucacgagcgccgugaucgacgcgcugccccgcaacauggucaucacgugccagggcuccgacgacauccgcaagcugcucgagagccaggggcggaaggacaucaagcugaucgacaucgcccugagcaagaucgacucccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgcggccgucagcgggggccugaacucccucgugcugcgggccgugcugccgcgggacauggucuuccgcaccagcacgccccggguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6103 - RNA, 1892 nt, Artificial Sequence
  mRNA product Design3 comprising derived and/or modified sequence from Lassa virus__AIT17161__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggaccgggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccguggucgaccucgaguccgacgggaagccccagaaggcgggcagcaacuccagcaacaagucccugcagagcgccggccugaccgccgggcucacguacucccagcugaugacccugaaggacgccaugcugcagcucgacccgaacgccaagaccuggauggacaucgagggccgccccgaggaccccguggagaucgcgcuguaccagcccagcuccgggugcuacauccacuucuuccgggagccgaccgaccugaagcaguucaagcaggacgccaaguacagccacggcaucgacgugacggaccucuucgccgcccagcccgggcugaccuccgccgucaucgacgcgcugccccgcaaccucgugaucacgugccagggcagcgacgacauccgcaagcugcuggagagccagggccggaaggacaucaagcucaucgacaucgcccuguccaagaccgacagccgcaaguacgagaacgccgugugggaccaguacaaggaccugugccacaugcacaccgggaucgucguggagaagaagaagcggggcgggaaggaggagaucacgccccacugcgcccucauggacugcaucauguucgacgcggccgucuccggcgggcugaacgccagcgugcugcgcgccgugcucccgcgggacauggucuuccgcaccuccacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6104 - RNA, 1892 nt, Artificial Sequence
  mRNA product Design3 comprising derived and/or modified sequence from Lassa virus__AIT17165__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgaggugaacaacgugcagcgccucaugcggaaggagcgccgggacgacaacgaccugaagcgccugcgggaccucaaccaggccgucaacaaccugguggagcugaaguccacccagcagaaguccauccuccgcgugggcacccugaccuccgacgaccugcucauccuggccgccgaccuggagaagcucaagagcaaggucacccggaccgagcgcccccuguccgccgggguguacaugggcaaccugagcucccagcagcucgaccagcggcgcgcgcugcugaacaugaucgggaugagcaacggcaaccagggcacgcgggccgggcgcgacggcgugguccgggugugggacgugaagaacgccgagcuccugaacaaccaguucgggaccaugccgucccugacccucgccugccugaccaagcagggccaggucgaccugaacgacguggugcaggcgcucacggaccuggggcugaucuacaccgccaaguaccccaacaccagcgaccucgaccgccugacccagucccaccccauccugaacaugaucgacacgaagaaguccagccucaacaucagcggcuacaacuucagccugggcgccgccgucaaggccggggcgugcaugcuggacggcgggaacaugcucgagaccaucaaggugagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccgucguggaccucgaguccgacgggaagccccagaaggccgacagcuccaacagcaacaagucccugcagagcgcgggcuucaccgccggccugacguacucccagcucaugacccugaaggacgccaugcugcagcuggacccgaacgccaagaccuggauggacaucgaggggcgccccgaggaccccguggaggucgcccucuaccagcccagcuccggcugcuacauccacuucuuccgggagccgaccgaccugaagcaguucaagcaggacgcgaaguacagccacgggaucgacgugacggaccuguucgccgcccagcccggccucaccuccgccgugaucgacgcccugccccgcaacauggucaucacgugccaggggagcgacgacauccgcaagcugcucgagucccagggccggaaggacaucaagcugaucgacaucgcgcugagcaaggccgacagccgcaaguacgagaacgccgugugggaccagcacaaggaccucugccacaugcacaccggcgucgugguggagaagaagaagcgcgggggcaaggaggagaucaccccgcacugcgcccugauggacugcaucauguacgacgcggccgucuccgggggccugaacaccagcgugcuccgggccgugcugccccgggacauggucuuccgcaccuccacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6105 - RNA, 1892 nt, Artificial Sequence
  mRNA product Design3 comprising derived and/or modified sequence from Lassa virus__AIT17169__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcuccggcaaccagcgggcccaggccggccgcgacggggugguccgggugugggacgugaagaacgucgagcuccugaacaaccaguucggcaccaugccgagccugacgcucgccugccugaccaagcagggccagguggaccugaacgacgcggugcaggcccucaccgaccuggggcugaucuacaccgccaaguaccccaacacguccgaccucgaccgccugacccagagccaccccauccugaacaugaucgacaccaagaaguccagccucaacaucagcggguacaacuucucccugggcgccgccgucaaggcgggcgccugcaugcuggacgggggcaacaugcucgagaccaucaaggugagcccccagacgauggacgggauccugaaguccauccugaaggugaagaaggcccucggcauguucaucagcgacaccccgggcgagcggaaccccuacgagaacauccuguacaagaucugccuguccggggacggcuggcccuacaucgccagccgcaccuccaucaccgggcgggccugggagaacacggucguggaccucgagagcgacggcaagccccagaaggcgggguccaacaacagcaacaagucccugcagagcgugggcuucaccgccggccugaccuacucccagcucaugacccugaaggacgccaugcugcagcuggacccgaacgccaagacguggauggacaucgaggggcgccccgaggaccccgucgagaucgcccucuaccagcccagcuccggcugcuacauccacuucuuccgggagccgaccgaccugaagcaguucaagcaggacgcgaaguacagccacgggaucgacgugaccgaccuguucgccgcccagcccggccucaccuccgccgugaucgacgcccugccccgcaacauggucaucacgugccaggggagcgacgacauccgcaagcugcucgagagccagggccggaaggacaucaagcugaucgacaucgcgcuguccaagaccgacagccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgccgcggucuccgggggccugaacaccagcgugcuccgggccgugcugccgcgggacauggucuuccgcaccuccacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6106 - RNA, 1892 nt, Artificial Sequence
  mRNA product Design3 comprising derived and/or modified sequence from Lassa virus__AIT17173__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgggacauggucuuccgcaccagcacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6107 - RNA, 1892 nt, Artificial Sequence
  mRNA product Design3 comprising derived and/or modified sequence from Lassa virus__AIT17177__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucgugcuggccgccgaccuggagaagcucaaguccaaggugauccggaccgagcgcccccugagcgccgggaucuacaugggcaaccuguccagccagcagcucgaccagcggcgcgcgcugcugaacaugaucgggauguccggcggcaaccagggggcccgggccggccgcgacggggucgugcgggugugggacgucaagaacgccgaccuccugaacaaccaguucggcaccaugccgagccugacgcucgcgugccugaccaagcagggccagguggaccugaacgacgugguccaggcccucaccgaccuggggcugaucuacaccgccaaguaccccaacacguccgaccucgaccgccugacccagagccaccccauccugaagaugaucgacgccaacaaguccagccucaacaucagcggcuacaacuucucccugggggccgcggugaaggccggcgccugcaugcuggacgggggcaacaugcucgagaccaucaaggugagcccccagaccauggacggcauccugaaguccauccugaaggucaagaagucccucgggauguucaucagcgacacgccgggcgagcggaaccccuacgagaacauccuguacaagaucugccugagcggggacggcuggcccuacaucgccucccgcaccagcaucaucgggcgggccugggagaacaccgugguggaccucgaguccgacggcaagccccagaagaccggcagcaacaacuccagcaagucccugcagagcgcgggguucgccgccggccugacguacucccagcucaugacccugaaggacgccaugcugcagcuggacccgaacgccaagaccuggauggacaucgaggggcgccccgaggaccccgucgagaucgcgcucuaccagcccagcuccggcugcuacauccacuucuuccgggagccgaccgaccugaagcaguucaagcaggacgccaaguacagccacgggaucgacgugacggaccuguucgccgcccagcccggccucaccuccgccgugaucgaggcgcugccccgcaacauggucaucacgugccagggcagcgacgacauccgcaagcugcucgagagccaggggcggaaggacaucaagcugaucgacaucgcccuguccaagaccgacagccgcaaguacgagaacgccgugugggaccaguacaaggaccucugccacaugcacaccggcaucgucguggagaagaagaagcgcgggggcaaggaggagaucacgccccacugcgcccugauggacugcaucauguucgacgcggccguguccgggggccugaacacccucguccugcgggccgugcugccgcgggacaugguguuccgcaccagcacccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6108 - RNA, 1892 nt, Artificial Sequence
  mRNA product Design3 comprising derived and/or modified sequence from Lassa virus__AIT17181__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacaacgaccugaagcgccugcgggaccucaaccaggccgugaacaaccugguggagcucaagagcacccagcagaaguccguccugcgcgugggcacccugaccagcgacgaccugcucgugcuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcauccaggggacccggacgggccgcgacggggugguccgggugugggacgugaagaacgccgaccuccugaacaaccaguucggcaccaugccgagccugacccucgccugccugaccaagcaggggcaggucgaccugaacgacguggugcaggcccucacggaccugggccugaucuacaccgcgaaguaccccaacgccuccgaccucgaccgccugacccagagccaccccauccugaacaugaucgacaccaagaaguccagccucaacaucagcggcuacaacuucucccugggggccgccgucaaggccggcgcgugcaugcuggacgggggcaacaugcucgagacgaucaaggugagcccccagaccauggacggcauccugaaguccauccugaaggugaagaagacccucgggauguucaucagcgacaccccgggcgagcggaaccccuacgagaacauccuguacaagaucugccuguccggggacggcuggcccuacaucgccagccgcacguccaucaccgggcgggccugggagaacaccgucguggaccucgagagcgacggcaagccccagaaggccggcuccaacaacagcaacaagucccugcagagcgccggguucgcggccggccugaccuacucccagcucaugacgcugaaggacgccaugcugcagcuggacccgaacgccaagaccuggauggacaucgaggggcgccccgaggaccccguggagaucgcccucuaccagcccagcuccggcugcuacauccacuucuuccgggagccgaccgaccugaagcaguucaagcaggacgcgaaguacagccacgggaucgacgucaccgaccuguucgccgcccagcccggccucacguccgccgugaucgaggcccugccccgcaacauggucaucacgugccagggcagcgacgacaucaagaagcugcucgagucccaggggcgcaaggacaucaagcugaucgacaucgcgcugagcaagaccgacagccggaaguacgagaacgccgugugggaccaguacaaggaccucugccacaugcacaccggcguggucguggagaagaagaagcgcgggggcaaggaggagaucaccccgcacugcgcccugauggacugcaucauguucgacgccgcgguguccgggggccugaacacccucguccugcgggccgugcugccccgcgacaugguguuccggaccagcacgccccgcgucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6109 - RNA, 1892 nt, Artificial Sequence
  mRNA product Design3 comprising derived and/or modified sequence from Lassa virus__AIT17185__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcucaagagcacccagcagaaguccgugcugcgcgucgggacccugaccagcgacgaccugcucauccuggccgccgaccuggagaagcucaaguccaaggugacccggaccgagcgcccccugagcgccggcguguacauggggaaccuguccagccagcagcucgaccagcggcgcgcgcugcugaacaugaucggcauguccggcgggaaccggggcgcccgcacggggaaggacggcgucgugcggaucugggacgugaagaacgccgaccuccugaacaaccaguucgggaccaugccgagccugacccucgccugccugaccaagcagggccaggucgaccugaacgacguggugcaggcgcucacggaccugggccugaucuacaccgccaaguaccccaacaccuccgaccucgaccgccugacccagagccaccccauccugaacaugaucgacacgaacaaguccagccucaacaucagcggguacaacuucucccugggcgccgccgucaaggccggggcgugcaugcuggacggcggcaacaugcucgagaccaucaaggugagcccccagaccauggacgggauccugaaguccauccugaaggugaagaagucccucggcauguucaucagcgacaccccgggggagcggaaccccuacgagaacauccuguacaagaucugccugagcggcgacggguggcccuacaucgccucccgcacgagcaucaccggccgggccugggagaacaccgucguggaccucgaguccgacgagaagccccagaaggccggcagcaacaacuccaacaagagccugcaguccaccggguucacggccggccugaccuacagccagcucaugacccugaaggacgcgaugcugcagcuggacccgaacgccaagaccuggauggacaucgaggggcgccccgaggaccccguggagaucgcccucuaccagcccuccagcggcugcuacauccacuucuuccgggagccgacggaccugaagcaguucaagcaggacgccaaguacucccacgggaucgacgucaccgaccuguucgccgcgcagcccggccucaccagcgccgugaucgacacccugccccgcaacauggugaucacgugccagggcuccgacgacauccgcaagcugcucgagagccaggggcggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucacgccccacugcgcccugauggacugcaucauguucgacgcggccgugagcgggggccugaacgccuccguccuccgggccgugcugccgcgggacaugguguuccgcaccagcacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6110 - RNA, 1892 nt, Artificial Sequence
  mRNA product Design3 comprising derived and/or modified sequence from Lassa virus__AIT17189__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggaccggccgcgacggggucgugcgggugugggacgucaagaacgccgagcuccugaacaaccaguucggcaccaugccgucccugacccucgccugccugaccaagcagggccagguggaccugaacgacgugguccaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggugagcccccagaccaucgacggcauccucaagagcauccugaaggucaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgugguggaccucgaguccgacggcaagccccagaaggccggcagcaacaacuccaacaagagccugcaguccgcgggguucaccgccggccugacguacagccagcucaugacccugaaggacgccaugcugcagcuggacccgaacgccaagaccuggauggacaucgaggggcgccccgaggaccccgucgagaucgcccucuaccagcccuccagcggcugcuacauccacuucuuccgggagccgaccgaccugaagcaguucaagcaggacgcgaaguacucccacgggaucgacgugacggaccuguucgccgcccagcccggccucaccagcgccgugaucgacgcccugccccgcaacauggucaucacgugccagggcuccgacgacauccgcaagcugcucgagagccaggggcggaaggacaucaagcugaucgacaucgcgcugagcaagaccgacucccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgccgcggucagcgggggccugaacucccucgugcugcgggccgugcugccgcgggacauggucuuccgcaccagcacgccccggguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6111 - RNA, 1892 nt, Artificial Sequence
  mRNA product Design3 comprising derived and/or modified sequence from Lassa virus__AIT17193__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggaccggccgcgacggggucgugcgggugugggacgucaagaacgccgagcuccugaacaaccaguucggcaccaugccgucccugacccucgccugccugaccaagcagggccagguggaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgucaaggcgggcgccugcaugcuggacgggggcaacaugcucgagaccaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgucguggaccucgaguccgacggcaagccccagaaggcgggcaacaacaacagcaacaagucccugcagagcgccggguucaccgccggccugacguacucccagcucaugacccugaaggacgccaugcugcagcuggacccgaacgccaagaccuggauggacaucgaggggcgccccgaggaccccguggagaucgcgcucuaccagcccagcuccggcugcuacauccacuucuuccgggagccgaccgaccugaagcaguucaagcaggacgccaaguacagccacgggaucgacgucacggaccuguucgccgcccagcccggccucaccuccgccgugaucgacgcgcugccccgcaacauggugaucacgugccagggcagcgacgacauccgcaagcugcucgagucccaggggcggaaggacaucaagcugaucgacaucgcccugagcaagaccgacagccgcaaguacgagaacgccgucugggaccaguacaaggaccucugccacaugcacaccggcguggucguggagaagaagaagcgcgggggcaaggaggagaucacgccccacugcgcccugauggacugcaucauguucgacgcggccguguccgggggccugaacagccucguccugcgggccgugcugccgcgggacaugguguuccgcaccuccacgccccgggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6112 - RNA, 1892 nt, Artificial Sequence
  mRNA product Design3 comprising derived and/or modified sequence from Lassa virus__AIT17197__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccugucccuccagcagcuggaccagcggcgcgcgcugcucaacaugaucgggaugagcggcuccaaccagggcgugcgggccgggcgcgacggcgucgugcgggugugggacgucaagaacgccgagcugcugaacaaccaguucgggaccaugccgagccucacgcuggccugccugaccaagcagggccagguggaccucaacgacgcggugcaggcccugaccgaccuggggcucaucuacaccgccaaguaccccaacacguccgaccuggaccgccugacccagagccaccccauccucaacaugaucgacaccaagaaguccagccugaacaucagcggcuacaacuucucccugggcgccgccgucaaggcgggggccugcaugcucgacggcgggaacaugcuggagaccaucaaggugagcccccagacgauggacggcauccugaaguccauccucaaggugaagaaggcccugggcauguucaucagcgacaccccgggggagcggaaccccuacgagaacauccuguacaagaucugccucuccggcgacggguggcccuacaucgccagccgcaccuccaucaccggccgggccugggagaacacggucguggaccuggagagcgacgggaagccccagaaggcgggcuccaacggcagcaacaagucccugcagagcgccggguucaccgccggccucaccuacucccagcugaugacccugaaggacgccaugcugcagcucgacccgaacgccaagacguggauggacaucgaggggcgccccgaggaccccguggagaucgcgcuguaccagcccagcuccggcugcuacauccacuucuuccgggagccgaccgaccugaagcaguucaagcaggacgccaaguacagccacgggaucgacgucaccgaccucuucgccgcccagcccggccugaccuccgccgugaucgacgcgcugccccgcaacauggugaucacgugccagggcagcgacgacauccgcaagcuccuggagucccaggggcggaaggacaucaagcugaucgacaucgcccucagcaagaccgacagccgcaaguacgagaacgccgucugggaccaguacaaggaccugugccacaugcacaccggcaucguggucgagaagaagaagcgcgggggcaaggaggagaucacgccccacugcgcccugauggacugcaucauguucgacgcggccguguccgggggccucaacaccagcgugcugcgggccguccugccgcgggacaugguguuccgcaccuccacgccccgggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6113 - RNA, 1892 nt, Artificial Sequence
  mRNA product Design3 comprising derived and/or modified sequence from Lassa virus__AIT17201__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacaucaagaagcuguucgagagccaggggcgcaaggacaucaagcucaucgacaucgcccugagcaagaccgacucccggaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgcgacauggucuuccggaccagcacgccccgcguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6114 - RNA, 1892 nt, Artificial Sequence
  mRNA product Design3 comprising derived and/or modified sequence from Lassa virus__AIT17205__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggaaggcgcugcugaacaugaucgggauguccggcagcaaccagggcgcccgcaucgggcgggacggcgugguccgcgugugggacgugaagaacgccgagcuccugaacaaccaguucgggacgaugccgucccugacccucgccugccugaccaagcagggccaggucgaccugaacgacgcggugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggucagcccccagaccauggacggcauccucaagagcauccugaaggugaagaaggcccugggcauguucaucuccgacaccccgggggagcgcaaccccuacgagaacauccuguacaagaucugccugagcggcgacggguggcccuacaucgccucccggaccagcaucacgggccgcgccugggagaacaccguggucgaccucgaguccgacgggaagccccagaaggcgggcagcaacuccagcaacaagucccugcagagcgccggccugaccgccgggcucaccuacucccagcugaugacgcugaaggacgccaugcugcagcucgacccgaacgccaagaccuggauggacaucgagggccggcccgaggaccccguggagaucgcgcuguaccagcccagcuccgggugcuacauccacuucuuccgcgagccgaccgaccugaagcaguucaagcaggacgccaaguacagccacggcaucgacgugaccgaccucuucgccgcccagcccgggcugacguccgccgucaucgacgcgcugccccggaaccucgugaucacgugccagggcagcgacgacauccgcaagcugcuggagagccagggccgcaaggacaucaagcucaucgacaucgcccuguccaagaccgacagccggaaguacgagaacgccgugugggaccaguacaaggaccugugccacaugcacaccgggaucgucguggagaagaagaagcgcggcgggaaggaggagaucaccccgcacugcgcccucauggacugcaucauguucgacgcggccgucuccggcgggcugaacgccagcgugcugcgggccgugcucccccgcgacauggucuuccggaccuccacgccccgcguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6115 - RNA, 1892 nt, Artificial Sequence
  mRNA product Design3 comprising derived and/or modified sequence from Lassa virus__AIT17209__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacguggugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagcugcagaagaccggcagcaacaacuccaacaagagccugcaguccgcgggguucaccgccggccucacguacagccagcugaugacccugaaggacgccaugcugcagcucgaccccaacgccaagaucuggauggacaucgaggggcgcccggaggaccccguggagaucgcccuguaccagcccuccagcggcugcuacauccacuucuuccgggagcccaccgaccugaagcaguucaagcaggacgcgaaguacucccacgggaucgacgucaccgaccucuucgccgcccagccgggccugacgagcgccgugaucgacgcccugccccgcaacauggugaucacgugccagggcuccgacgacauccgcaagcuccuggagagccaggggcggaaggacaucaagcugaucgacaucgcgcucaacaagaccgacagccgcaaguacgagaacgccgucugggaccaguacaaggaccugugccacaugcacaccggcguggucguggagaagaagaagaagggcgggaaggaggagaucacgccccacugcgcccugauggacugcaucauguucgacgccgcgguguccgggggccucaacaccagcguccugcgggccgugcugccccgcgacaugguguuccggaccuccaccccgcgcgucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6116 - RNA, 1892 nt, Artificial Sequence
  mRNA product Design3 comprising derived and/or modified sequence from Lassa virus__AIT17211__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccaggccggccgggacggggugguccgcgugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccggcugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaaguccauccugaaggugaagaaggcccucgggauguucaucagcgacaccccgggcgagcgcaaccccuacgagaacauccuguacaagaucugccuguccggggacggcuggcccuacaucgccagccggaccuccaucacggggcgcgcgugggagaacaccguggucgaccucgagagcgacggcaagccccagaaggccaacuccaacagcuccaacaagagccugcaguccgccggcuucaccgccgggcugaccuacagccagcucaugacgcugaaggacgccaugcugcagcuggacccgaacgcgaagaccuggauggacaucgagggccggcccgaggaccccguggagaucgcccucuaccagcccuccagcgggugcuacauccacuucuuccgcgagccgaccgaccugaagcaguucaagcaggacgccaaguacucccacggcaucgacgugaccgaccuguucgccgcccagcccgggcucacgagcgcggucaucgacgcccugccccggaacauggugaucacgugccagggcuccgacgacauccgcaagcugcucgagagccagggccgcaaggacaucaagcugaucgacaucgcccugagcaagaccgacucccggaaguacgagaacgccgugugggaccaguacaaggaccucugccacaugcacaccgggaucgucguggagaagaagaagcgcggcgggaaggaggagaucaccccgcacugcgcgcugauggacugcaucauguucgacgccgccgucagcggcgggcugaacaccuccgugcuccgggccgugcugccccgcgacauggucuuccggaccagcacgccccgcguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6117 - RNA, 1892 nt, Artificial Sequence
  mRNA product Design3 comprising derived and/or modified sequence from Lassa virus__AIT17213__NP (opt1)
gggagaaagcuuaccaugagcgccuccaaggagaucaagagcuuccuguggacccagucccuccgccgggagcuggccggcuacugcagcaacaucaagcuccagguggucaaggacgcgcaggcccugcugcacgggcuggacuucuccgaggugagcaacgugcagcgccucaugcggaaggagcgccgggacgacaacgaccugaagcgccugcgggaccucaaccaggccgucaacaaccugguggagcugaaguccacccagcagaaguccgugcuccgcgucggcacccugaccagcgacgaccugcucauccuggccgccgaccuggagaagcucaagagcaaggugauccggaccgagcgcccccuguccgcggggguguacaugggcaaccugagcucccagcagcucgaccagcggcgcgcccugcugaacaugaucgggaugagcggcuccaaccagggcguccgggccgggcgcgacggcguggugcgggucugggacgugaagaacgccgagcuccugaacaaccaguucgggaccaugccgagccugacgcucgcgugccugaccaagcagggccagguggaccugaacgacgccguccaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggcgccgcggugaaggccggggccugcaugcuggacggcgggaacaugcucgagaccaucaaggugagcccccagacgauggacggcauccugaaguccauccugaaggucaagaaggcccucggcauguucaucagcgacaccccgggggagcggaaccccuacgagaacauccuguacaagaucugccuguccggcgacggguggcccuacaucgccagccgcaccuccaucaccggccgggcgugggagaacacggugguggaccucgagagcgacgggaagccccagaaggccggcuccaacggcagcaacaagucccugcagagcgccggguucaccgccggccugaccuacucccagcucaugacccugaaggacgccaugcugcagcuggacccgaacgcgaagacguggauggacaucgaggggcgccccgaggaccccgucgagaucgcccucuaccagcccagcuccggcugcuacauccacuucuuccgggagccgaccgaccugaagcaguucaagcaggacgccaaguacagccacgggaucgacgugaccgaccuguucgccgcccagcccggccucaccuccgcggugaucgacgcccugccccgcaacauggucaucacgugccagggcagcgacgacauccgcaagcugcucgagucccaggggcggaaggacaucaagcugaucgacaucgcccugagcaagaccgacagccgcaaguacgagaacgccgugugggaccaguacaaggaccucugccacaugcacaccggcaucgucguggagaagaagaagcgcgggggcaaggaggagaucacgccccacugcgcgcugauggacugcaucauguucgacgccgccguguccgggggccugaacaccagcguccuccgggccgugcugccgcgggacaugguguuccgcaccuccacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6118 - RNA, 1892 nt, Artificial Sequence
  mRNA product Design3 comprising derived and/or modified sequence from Lassa virus__AIT17217__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcuccggcgugcagggcgcccgggccgggcgcgacggcgucgugcgggugugggacgucaagaacgccgagcuccugaacaaccaguucgggacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggugagcccccagaccauggacggcauccugaaguccauccugaaggucaagaaggcccucggcauguucaucagcgagaccccgggggagcggaaccccuacgagaacauccuguacaagaucugccuguccggcgacggguggcccuacaucgccagccgcaccuccaucacgggccgggccugggagaacaccgugguggaccucgagagcgacgggaagccccagaaggcgggcuccaacaacagcaacaagucccugcagagcaccggcuucgccgccgggcugaccuacucccagcucaugacgcugaaggacgccaugcugcagcuggacccgaacgccaagaccuggauggacaucgagggccgccccgaggaccccgucgagguggcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgucaucgacgcgcugccccgcaacauggugaucacgugccagggcagcgacgacaucaagaagcugcucgagagccagggccgcaaggacaucaagcugaucgacaucgcccuguccaagaccgacagccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccguguccggcgggcugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6119 - RNA, 1892 nt, Artificial Sequence
  mRNA product Design3 comprising derived and/or modified sequence from Lassa virus__AIT17225__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcugaacaugaucgggauguccggcggcaaccagggggcccgggccggcaacgacgggguggugcgcgucugggacgugaagaacgccgaccuccugaacaaccaguucggcacgaugccgagccugacccucgcgugccugaccaagcagggccagguggaccugaacgacgucgugcaggcccucaccgaccuggggcugaucuacacggccaaguaccccaacaccuccgaccucgaccggcugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggucagcccccagaccauggacggcauccugaaguccauccugaaggugaagaaggcccucgggauguucaucagcgacaccccgggcgagcgcaaccccuacgagaacauccuguacaagaucugccuguccggggacggcuggcccuacaucgccagccggaccuccaucacggggcgcgccugggagaacaccguggucgaccucgagagcgacggcaagccccagaagaccggcaacaacuccagcaacaagucccugcagagcgcgggguucaccgccggccugacguacucccagcucaugacccugaaggacgccaugcugcagcuggacccgaacgccaagaccuggauggacaucgaggggcggcccgaggaccccguggagguggcccucuaccagcccagcuccggcugcuacauccacuucuuccgcgagccgaccgaccugaagcaguucaagcaggacgcgaaguacagccacgggaucgacgucacggaccuguucgccgcccagcccggccucaccuccgccgugaucgaggcccugccccggaacauggucaucacgugccagggcagcgacgacauccgcaagcugcucgagucccaggggcgcaaggacaucaagcugaucgacaucgcgcugagcaagaucgacagccggaaguacgagaacgccgugugggaccaguacaaggaccucugccacaugcacaccggcguggucguggagaagaagaagcgcgggggcaaggaggagaucacgccccacugcgcccugauggacugcaucauguucgacgccgcgguguccgggggccugaacacccucguccugcgggccgugcugccgcgcgacaugguguuccggaccagcacccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6120 - RNA, 1892 nt, Artificial Sequence
  mRNA product Design3 comprising derived and/or modified sequence from Lassa virus__AIT17229__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcuguccaugaucgggaugagcggcggcaaccaggggacccgggccggccgcgacggggucgugcgggugugggacgucaagaacgccgagcuccugaacaaccaguucggcaccaugccgucccugacccucgccugccugaccaagcagggccagguggaccugaacgacgcggugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagccccagaaggcgggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccguggagaucgcgcucuaccagcccuccagcggcugcuacauccacuucuuccgggagccgaccgaccugaagcaguucaagcaggacgccaaguacucccacgggaucgacgucaccgaccuguucgccgcccagcccggccucacgagcgccgugaucgacgcgcugccccgcaacauggugaucacgugccagggcuccgacgacauccgcaagcugcucgagagccaggggcggaaggacaucaagcugaucgacaucgcccugagcaaggccgacucccgcaaguacgagaacgccgucugggaccaguacaaggaccucugccacaugcacaccggcguggucguggagaagaagaagcgcgggggcaaggaggagaucacgccccacugcgcgcugauggacugcaucauguucgacgccgccgugagcgggggccugaacaccuccguccuccgggccgugcugccgcgggacaugguguuccgcaccagcacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6121 - RNA, 1892 nt, Artificial Sequence
  mRNA product Design3 comprising derived and/or modified sequence from Lassa virus__AIT17233__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaaggagcgccgggacgacaacgaccugaagcgccugcgggaccucaaccaggccgugaacaaccugguggagcucaagagcacccagcagaaguccauccugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagggggcccaggccggccgggacgggguggugcgcgucugggacgugaagaacgccgagcuccugaacaaccaguucggcacgaugccgucccugacccucgcgugccugaccaagcagggccagguggaccugaacgacgccguccaggcccucaccgaccuggggcugaucuacacggccaaguaccccaacaccagcgaccucgaccggcugacccagucccaccccauccugaacaugaucgacaccaagaaguccagccucaacaucagcggcuacaacuucagccugggggccgcggugaaggccggcgccugcaugcuggacgggggcaacaugcucgagacgaucaaggugagcccccagaccauggacggcauccucaagagcauccugaaggucaagaaggcccuggggauguucaucuccgacaccccgggcgagcgcaaccccuacgagaacauccuguacaagaucugccugagcggggacggcuggcccuacaucgccucccggaccagcaucacggggcgcgcgugggagaacaccgugguggaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcggcccgaggaccccgucgagguggcccucuaccagcccuccagcggcugcuacauccacuucuuccgcgagccgaccgaccugaagcaguucaagcaggacgccaaguacucccacgggaucgacgugaccgaccuguucgccgcccagcccggccucacgagcgcggucaucgacgcccugccccggaacauggugaucacgugccagggcuccgacgacauccgcaagcugcucgagagccaggggcgcaaggacaucaagcugaucgacaucgcccugagcaagaccgacucccggaaguacgagaacgccgucugggaccaguacaaggaccucugccacaugcacaccggcgugguggucgagaagaagaagcgcgggggcaaggaggagaucaccccgcacugcgcgcugauggacugcaucauguucgacgccgccgugagcgggggccugaacaccuccgugcuccgggccguccugccccgcgacaugguguuccggaccagcacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6122 - RNA, 1892 nt, Artificial Sequence
  mRNA product Design3 comprising derived and/or modified sequence from Lassa virus__AIT17237__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagacgaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagguggcccucuaccagcccuccagcggcugcuacauccacuucuuccgggagccgaccgaccugaagcaguucaagcaggacgccaaguacucccacgggaucgacgucaccgaccuguucgccgcccagcccggccucacgagcgcggugaucgacgcccugccccgcaacauggugaucacgugccagggcuccgacgacauccgcaagcugcucgagagccaggggcggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucaccccgcacugcgcgcugauggacugcaucauguucgacgccgccgugagcgggggccugaacaccuccguccuccgggccgugcugccccgggacaugguguuccgcaccagcacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6123 - RNA, 1892 nt, Artificial Sequence
  mRNA product Design3 comprising derived and/or modified sequence from Lassa virus__AIT17241__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagacgaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcccagcccggccucacgagcgcggucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcgucguggucgagaagaagaagcgcgggggcaaggaggagaucaccccgcacugcgcgcucauggacugcaucauguucgacgccgccgugagcgggggccugaacaccuccgugcugcgggccguccucccccgggacaugguguuccgcaccagcacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6124 - RNA, 1892 nt, Artificial Sequence
  mRNA product Design3 comprising derived and/or modified sequence from Lassa virus__AIT17245__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggacggggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccguggucgaccucgaguccgacgggaagccccagaaggcgggcagcaacaacuccaacaagagccugcaguccgccggccugaccgccgggcucacguacagccagcugaugacccugaaggacgccaugcugcagcucgacccgaacgccaagaccuggauggacaucgagggccgccccgaggaccccguggagaucgcgcuguaccagcccuccagcgggugcuacauccacuucuuccgggagccgaccgaccugaagcaguucaagcaggacgccaaguacucccacggcaucgacguggccgaccucuucgccgcccagcccgggcugacgagcgcggucaucgacgcccugccccgcaaccucgugaucacgugccagggcuccgacgacauccgcaagcugcuggagagccagggccggaaggacaucaagcucaucgacaucgcccugagcaagaccgacucccgcaaguacgagaacgccgugugggaccaguacaaggaccugugccacaugcacaccgggaucgucguggagaagaagaagcggggcgggaaggaggagaucaccccgcacugcgcgcucauggacugcaucauguucgacgccgccgucagcggcgggcugaacgccuccgugcugcgcgccgugcucccccgggacauggucuuccgcaccagcacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6125 - RNA, 1892 nt, Artificial Sequence
  mRNA product Design3 comprising derived and/or modified sequence from Lassa virus__AIT17247__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucauccuggccgccgaccuggagaagcucaagagcaaggugauccggaccgagcgcccccuguccagcgggguguacaugggcaaccuguccagccagcagcucgaccagcggcgcgcccugcugaacaugaucgggauguccggcggcaaccagggggcgcaggucggccgggacgggguggugcgcgucugggacgugaagaacgccgaccuccugaacaaccaguucggcaccaugccgagccugacgcucgccugccugaccaagcagggccagguggaccugaacgacgucgugcaggcccucaccgaccuggggcugaucuacaccgcgaaguaccccaacacguccgaccucgaccggcuggcccagagccaccccauccugaacaugaucgacaccaagaaguccagccucaacaucagcggcuacaacuucucccugggggccgccgugaaggccggcgcgugcaugcuggacgggggcaacaugcucgagaccaucaaggucagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaaggccggcuccaacaacagcaacaagucccugcagagcgcgggguucacggccggccugaccuacucccagcucaugacccugaaggacagcaugcugcagcuggacccgaacgccaagaccuggauggacaucgaggggcggcccgaggaccccgucgagguggcccucuaccagcccuccagcggcugcuacauccacuucuuccgcgagccgacggaccugaagcaguucaagcaggacgccaaguacucccacgggaucgacgugaccgaccuguucgcggcccagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgcggucugggaccaguacaaggaccucugccacaugcacaccggcgugguggucgagaagaagaagcgcgggggcaaggaggagaucacgccccacugcgcccugauggacugcaucauguucgacgccgccguguccgggggccugaagacccucgugcugcgggcgguccugccgcgcgacaugguguuccggaccagcacccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6126 - RNA, 1892 nt, Artificial Sequence
  mRNA product Design3 comprising derived and/or modified sequence from Lassa virus__AIT17251__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucauccuggccgccgaccuggagaagcucaagagcaaggugauccggaccgagcgcccccuguccagcgggguguacaugggcaaccuguccagccagcagcucgaccagcggcgcgcccugcugaacaugaucgggauguccggcggcaaccagggggcgcaggucggccgggacgggguggugcgcgucugggacgugaagaacgccgaccuccugaacaaccaguucggcaccaugccgagccugacgcucgccugccugaccaagcagggccagguggaccugaacgacgucgugcaggcccucaccgaccuggggcugaucuacaccgcgaaguaccccaacacguccgaccucgaccggcuggcccagagccaccccauccugaacaugaucgacaccaagaaguccagccucaacaucagcggcuacaacuucucccugggggccgccgugaaggccggcgcgugcaugcuggacgggggcaacaugcucgagaccaucaaggucagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaagacgggcuccaacaacagcaacaagucccugcagagcgccggguucaccgcgggccugaccuacucccagcucaugacccugaaggacagcaugcugcagcuggacccgaacgccaagacguggauggacaucgaggggcggcccgaggaccccgucgagguggcccucuaccagcccuccagcggcugcuacauccacuucuuccgcgagccgaccgaccugaagcaguucaagcaggacgccaaguacucccacgggaucgacgugaccgaccuguucgccgcgcagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgccgucugggaccaguacaaggaccucugccacaugcacaccggcgugguggucgagaagaagaagcgcgggggcaaggaggagaucacgccccacugcgcgcugauggacugcaucauguucgacgccgccguguccgggggccugaagacccucgugcugcgggccguccugccgcgcgacaugguguuccggaccagcacccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6127 - RNA, 1892 nt, Artificial Sequence
  mRNA product Design3 comprising derived and/or modified sequence from Lassa virus__AIT17255__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagcgggcccaggccgggcgcgacggcguggugcgggucugggacgugaagaacgccgagcuccugaacaaccaguucgggacgaugccgucccugacccucgcgugccugaccaagcagggccagguggaccugaacgacgccguccaggcccucaccgaccuggggcugaucuacacggugaaguaccccaacgccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagaccaucaaggucagcccccagacgauggacggcauccucaagagcauccugaaggugaagaagacccugggcauguucaucuccgacaccccgggggagcggaaccccuacgagaacauccuguacaagaucugccugagcggcgacggguggcccuacaucgccucccgcaccagcaucacgggccgggccugggagaacaccguggucgaccucgaguccaacgggaagccccagaaggcggacagcaacuccagcaacaagucccugcagagcgccggcuucaccgccggccugaccuacucccagcucaugacgcugaaggacgccaugcugcagcuggacccgaacgccaagaccuggauggacaucgaggggcgccccgaggaccccguggagaucgcguucuaccagcccagcuccggcugcuacauccacuucuuccgggagccgaccgaccucaagcaguucaagcaggacgccaaguacagccacgggaucgacgugaccgaccuguucgccgcccagcccggccugacguccgccgucaucgacgcgcucccccgcaacauggugaucacgugccaggggagcgacgacauccgcaagcugcuggagagccagggccggaaggacaucaagcucaucgacaucgcccuguccaagaccgacagccgcaaguacgagaacgccgucugggaccaguacaaggaccugugccacaugcacaccggcgugguggucgagaagaagaagcgcgggggcaaggaggagaucaccccgcacugcgcccucauggacugcaucauguucgacgcggccguguccgggggccugaacacccuggugcuccgggccguccugccccgggacaugguguuccgcaccagcacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6128 - RNA, 1892 nt, Artificial Sequence
  mRNA product Design3 comprising derived and/or modified sequence from Lassa virus__AIT17259__NP (opt1)
gggagaaagcuuaccaugagcgccuccaaggagaucaagagcuuccuguggacccagucccuccgccgggagcugagcuccuacugcagcaacaucaagcuccagguggucaaggacgcccaggcgcugcugcacggccuggacuucuccgaggugagcaacgugcagcgccucaugcggaaggagcgccgggacgacaacgaccugaagcgccugcgggaccucaaccaggccgucaacaaccugguggagcugaaguccacccagcagaaguccauccuccgcguggggacccugaccagcgacgaccugcucauccuggccgccgaccuggagaagcucaagagcaaggucacccggaccgagcgcccccuguccgccggcguguacauggggaaccugagcucccagcagcucgaccagcggcgcgcgcugcugaacaugcucggcaugagcggguccaaccagggcgcccgggccggccgcgacggggugguccgggugugggacgugaagaacgccgagcugcugaacaaccaguucggcacgaugccgagccucacccuggcgugccugaccaagcaggggcaggucgaccucaacgacgccgugcaggcccugaccgaccugggccucaucuacacggccaaguaccccaacaccuccgaccuggaccgccugacccagagccaccccauccucaacaugaucgacaccaagaaguccagccugaacaucagcggguacaacuucucccugggcgccgcggugaaggccggcgccugcaugcucgacgggggcaacaugcuggagacgaucaaggucagcccccagaccauggacgggauccugaaguccauccucaaggugaagaaggcccugggcauguucaucagcgacaccccgggcgagcggaaccccuacgagaacauccuguacaagaucugccucuccggggacggcuggcccuacaucgccagccgcaccuccaucacggggcgggcgugggagaacaccguggucgaccuggagagcgacggcaagccccagaaggccggguccaacagcuccaacaagagccugcaguccgccggcuucaccgccggccucaccuacagccagcugaugacgcugaaggacgccaugcugcagcucgacccgaacgcgaagaccuggauggacaucgaggggcgccccgaggaccccguggagaucgcccuguaccagcccuccagcggcugcuacauccacuucuuccgggagccgaccgaccugaagcaguucaagcaggacgccaaguacucccacgggaucgacgugaccgaccucuucgccgcccagcccggccugacgagcgcggucaucgacgcccugccccgcaacauggugaucacgugccaggggagcgacgacauccgcaagcuccuggagucccagggccggaaggacaucaagcugaucgacaucgcccucagcaagaccgacucccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucagcgggggccucaacgccuccgugcugcgggccgugcugccccgggacauggucuuccgcaccagcacgccccggguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6129 - RNA, 1892 nt, Artificial Sequence
  mRNA product Design3 comprising derived and/or modified sequence from Lassa virus__AIT17263__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacggucguggaccucgagagcgacggcaagccccagaaggccggcuccaacgggagcaacaagucccugcagagcgccggcuucaccgccgggcugaccuacucccagcucaugacccugaaggacgccaugcugcagcuggacccgaacacgaagaccuggauggacaucgagggccgccccgaggaccccguggaggucgcgcucuaccagcccagcuccgggugcuacauccacuucuuccgggagccgaccgaccugaagcaguucaagcaggacgccaaguacagccacggcaucgacgugaccgaccuguucgccgcccagcccggccucacguccgccgugaucgacgcgcugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucgucguggagaagaagaagcggggcgggaaggaggagaucaccccgcacugcgcccugauggacugcaucauguucgacgcggccguguccggcggccugaacaccagcguccuccgcgccgugcugccccgggacaugguguuccgcaccuccacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6130 - RNA, 1892 nt, Artificial Sequence
  mRNA product Design3 comprising derived and/or modified sequence from Lassa virus__AIT17267__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggguggucguggagaagaagaagcggggcgggaaggaggagaucacgccccacugcgcccugauggacugcaucauguucgacgccgccgugagcggcgggcugaacaccuccguccuccgcgccgugcugccgcgggacaugguguuccgcaccaccacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6131 - RNA, 1892 nt, Artificial Sequence
  mRNA product Design3 comprising derived and/or modified sequence from Lassa virus__AIT17271__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaagaccauccugaaggugaagaaggcccucgggauguucaucuccgacaccccgggcgagcggaaccccuacgagaacauccuguacaagaucugccugagcggggacggcuggcccuacaucgccucccgcacgagcaucaccgggcgggcgugggagaacaccguggucgaccucgaguccgacggcaagccccagaagaccggcagcaacaacuccaacaagagccugcaguccgccggguucgccgccggccugacguacagccagcucaugacccugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugacggaccuguucgccgcccagcccggccucaccagcgcggucaucgacgcccugccccgcaacauggugaucacgugccagggcuccgacgacauccgcaagcugcucgagagccaggggcggaaggacaucaagcugaucgacaucgcccuguccaaggccgacagccgcaaguacgagaacgcggugugggaccaguacaaggaccucugccacaugcacaccggcgucguggucgagaagaagaagcgcgggggcaaggaggagaucaccccgcacugcgcccugauggacugcaucauguacgacgccgccgugagcgggggccuguccaccagcgugcuccgggccguccugccccgggacaugguguuccgcaccuccacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6132 - RNA, 1892 nt, Artificial Sequence
  mRNA product Design3 comprising derived and/or modified sequence from Lassa virus__AIT17275__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcugaaguccacccagcagaaguccgugcuccgcgucgggacgcugaccagcgacgaccugcucacccuggccgccgaccuggagaagcucaaguccaaggugacccggacggagcgcccccugagcgccggcguguacauggggaaccuguccagccagcagcucgaccagcggcgcgcgcugcugaacaugaucggcauguccggcgggaaccagggcgcccggaccgggaaggacggcgucgugcgcaucugggacgugaagaacgccgaccuccugaacaaccaguucgggaccaugccgagccugacccucgccugccugacgaagcagggccaggucgaccugaacgacguggugcaggcgcucaccgaccugggccugaucuacaccgccaaguaccccaacaucuccgaccucgaccggcuggcccagagccaccccauccugaagaugaucgacaccuccaagagcagccucaacaucuccggguacaacuucagccugggcgccgccgucaaggcgggggccugcaugcuggacggcggcaacaugcucgagacggugaaggugagcccccagaccauggacgggauccucaagagcauccugaaggucaagaagucccugggcauguucaucagcgacaccccgggggagcgcaaccccuacgagaacauccuguacaagaucugccuguccggcgacggguggcccuacaucgccagccggaccuccaucacgggccgcgccugggagaacaccgugguggaccucgagagcgacggcaagccccagaaggucggguccaacaacagcaacaagucccugcagagcaccggcuucaccgccgggcugacguacucccagcucaugacccugaaggacgcgaugcugcagcuggacccgaacgccaagaccuggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugacggaccuguucgccgcgcagcccggccucaccuccgccgucaucgacacccugccccggaacauggugaucacgugccaggggagcgacgacaucggcaagcugcucgagagccaggggcgcaaggacaucaagcugaucgacaucgcccuguccaagaccgacagccgcaaguacgagaacgccgucugggaccaguacaaggaccucugccacaugcacaccggcgugguggucgagaagaagaagcgcgggggcaaggaggagaucaccccgcacugcgcccugauggacugcaucauguucgacgcggccguguccggcgggcugaacgccagcgugcuccgggccguccugccccgggacaugguguuccgcaccuccacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6133 - RNA, 1892 nt, Artificial Sequence
  mRNA product Design3 comprising derived and/or modified sequence from Lassa virus__AIT17277__NP (opt1)
gggagaaagcuuaccaugagcgccuccaaggagaucaagagcuuccuguggacccagucccuccgccgggagcugagcuccuacugcagcaacaucaagcuccagguggucaaggacgcccaggcgcugcugcacggccuggacuucuccgaggugagcaacgugcagcgccucaugcggaaggagcgccgggacgacaacgaccugaagcgccugcgggaccucaaccaggccgucaacaaccugguggagcugaaguccacccagcagaaguccauccuccgcguggggacccugaccuccgacgaccugcucauccuggccgccgaccuggagaagcucaagagcaaggucacccggaccgagcgcccccuguccgccggcguguacauggggaaccugagcucccagcagcucgaccagcggcgcgcgcugcugagcaugaucggcauguccgggagcaaccagggcgcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagagccaccccauccugaacaugaucgacaccaagaaguccagccucaacaucuccggguacaacuucagccugggcgccgcggugaaggccggcgccugcaugcuggacgggggcaacaugcucgagacgaucaaggucagcccccagaccauggacgggauccucaagagcauccugaaggugaagaaggcccugggcauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccgggagcaacaacuccaacaagagccugcaguccgccggcuucaccgccggccugaccuacagccagcucaugacgcugaaggacgccaugcugcagcuggacccgaacgcgaagaccuggauggacaucgaggggcgccccgaggaccccguggagguggcccucuaccagcccuccagcggcugcuacauccacuucuuccgggagccgaccgaccugaagcaguucaagcaggacgccaaguacucccacgggaucgacgucaccgaccuguucgccgcccagcccggccucacgagcgcggugaucgacgcccugccccgcaacauggugaucacgugccaggggagcgacgacauccgcaagcugcucgagucccagggccggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucaccccgcacugcgcgcugauggacugcaucauguucgacgccgccgugagcgggggccugaacaccuccguccuccgggccgugcugccccgggacaugguguuccgcaccagcacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6134 - RNA, 1892 nt, Artificial Sequence
  mRNA product Design3 comprising derived and/or modified sequence from Lassa virus__AIT17281__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggcccgggccggccgcgacgggguggugcggaucugggacgucaagaacgccgagcuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccuccaccacgaacagcaacaagucccugcagagcgcgggcuucgccgccgggcugaccuacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgacggaccugaagcaguucaagcaggacgccaaguacagccacggcaucgacgucaccgaccuguucgccgcccagcccgggcucaccuccgccgugaucgacacccugccccgcaacauggugaucacgugccagggcagcgaggacauccgccggcugcucgagagccagggccgcaaggacaucaagcugaucgacaucgcgcuguccaagaccgacagccggaaguacgagaacgccgucugggaccaguacaaggaccucugccacaugcacaccgggguggucguggagaagaagaagaagggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6135 - RNA, 1892 nt, Artificial Sequence
  mRNA product Design3 comprising derived and/or modified sequence from Lassa virus__AIT17285__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgcagcaugcggaaggagcgccgggacgacaacgaccucaagcgccugcgggaccugaaccaggccgucaacaaccucguggagcugaaguccacccagcagaaguccauccugcgcgugggcacccucaccagcgacgaccugcugauccucgccgccgaccuggagaagcucaagagcaaggucacccggaccgagcgcccccuguccgccgggguguacaugggcaaccugagcucccagcagcuggaccagcggcgcgcgcuccugaacaugaucgggaugagcggcuccaaccagggcgcccgggccgggcgcgacggcgugguccgggugugggacgugaagaacgccgagcugcucaacaaccaguucgggacgaugccgagccugacccuggcgugccucaccaagcagggccaggucgaccugaacgacguggugcaggcccugaccgaccucgggcugaucuacacggccaaguaccccaacgccuccgaccuggaccgccucacccagagccaccccauccugaacaugaucgacaccaagaaguccagccugaacaucagcggcuacaacuucucccucggcgccgcggucaaggccggggccugcaugcuggacggcgggaacaugcuggagaccaucaaggugagcccccagacgauggacggcauccucaaguccauccugaaggugaagaaggcccugggcauguucaucagcgacaccccgggggagcggaaccccuacgagaacauccucuacaagaucugccuguccggcgacggguggcccuacaucgccagccgcaccuccaucaccggccgggcgugggagaacacgaucgucgaccuggagagcgacgggaagccccagaaggccggcaacaacggcuccaacaagagccuccaguccgccggguucaccgccggccugaccuacagccagcugaugacccucaaggacgccaugcugcagcuggacccgaacgcgaagacguggauggacaucgaggggcgccccgaggaccccguggagaucgcccuguaccagcccuccagcggcugcuacauccacuucuuccgggagccgaccgaccucaagcaguucaagcaggacgccaaguacucccacgggaucgacgugaccgaccuguucgccgcccagcccggccugaccagcgcggucaucgacgcccucccccgcaaccuggugaucacgugccagggcuccgacgacauccgcaagcugcucgagagccaggggcggaaggacaucaagcugaucgacaucgcccugagcaagaccgacucccgcaaguacgagaacgccgugugggaccaguacaaggaccucugccacaugcacaccggcaucgucguggagaagaagaagcgcgggggcaaggaggagaucacgccccacugcgcgcugauggacugcaucauguucgacgccgccgucagcgggggccugaacaccuccgugcuccgggccgugcugccgcgggacauggucuuccgcaccagcacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6136 - RNA, 1892 nt, Artificial Sequence
  mRNA product Design3 comprising derived and/or modified sequence from Lassa virus__AIT17289__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggugcgggccggccgcgacggggugguccggaucugggacgugaagaacgccgagcuccugaacaaccaguucggcacgaugccgagccugacccucgccugccugaccaagcagggccagguggaccugaacgacgucgugcaggcgcucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggccggcgcgugcaugcuggacgggggcaacaugcucgagacgaucaaggucagcccccagaccauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccggcuccaucaacagcaacaagucccugcagagcaccggguucgccgcgggccugacguacucccagcucaugacccugaaggacgccaugcugcagcuggacccgaacgccaagaccuggauggacaucgaggggcgccccgaggaccccgucgagaucgcccucuaccagcccagcuccggcugcuacauccacuucuuccgggagccgaccgaccugaagcaguucaagcaggacgccaaguacagccacgggaucgacgugacggaccuguucgcggcccagcccggccucaccuccgccgugaucgacgcccugccccgcaacauggucaucacgugccagggcagcgacgacauccgcaagcugcucgagagccaggggcggaaggacaucaagcugaucgacaucgcccuguccaagaccgacagccgcaaguacgagaacgcggugugggaccaguacaaggaccucugccacaugcacaccggcaucgucguggagaagaagaagcgcgggggcaaggaggagaucaccccgcacugcgcccugauggacugcaucauguucgacgccgccguguccgggggccugaacaccagcguccuccgggcggugcugccccgggacaugguguuccgcaccuccacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6137 - RNA, 1892 nt, Artificial Sequence
  mRNA product Design3 comprising derived and/or modified sequence from Lassa virus__AIT17293__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaaguccaaggugacccggaccgagcgcccccugagcgccggggucuacaugggcaaccuguccacgcagcagcucgaccagcggcgcgcgcugcugaacaugaucgggaugagcggcggcaaccagggggcccgggccggccgcgacgggguggugcgggucugggacgugaagaacgccgaccuccugaacaaccaguucggcaccaugccgucccugacccucgcgugccugaccaagcagggccagguggaccugaacgacgucgugcaggcccucacggaccuggggcugaucuacaccgccaaguaccccaacaccagcgaccucgaccgccugacccagucccaccccauccugaacaugaucgacacgaacaagagcucccucaacaucagcggcuacaacuucagccugggggccgccgugaaggcgggcgccugcaugcuggacgggggcaacaugcucgagaccaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccguggucgaccucgaguccgacggcaagccccagaaggcgggcgggaacaacagcaacaagucccugcagagcgccggcuucaccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgugacggaccuguucgccgcccagcccggccucaccuccgccgucaucgacgcgcugccccgcaacauggugaucacgugccaggggagcgacgacauccgcaagcugcucgagucccagggccggaaggacaucaagcugaucgacaucgcccugagcaagaccgacucccgcaaguacgagaacgccgucugggaccaguacaaggaccucugcaacaugcacaccgggaucgugguggagaagaagaagcggggcgggaaggaggagaucaccccgcacugcgcccugauggacugcaucauguucgacgcggccgucagcggcggcaugaacaccagcgugcugcgcgccgugcucccccgggacauggucuuccgcaccuccacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6138 - RNA, 1892 nt, Artificial Sequence
  mRNA product Design3 comprising derived and/or modified sequence from Lassa virus__AIT17295__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacgaucgucgaccucgagagcgacggcaagccccagaaggccggcuccaacgggagcaacaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccgcccagcccggccucaccuccgcgaucaucgacgcccugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucguggucgagaagaagaagcggggcgggaaggaggagaucacgccccacugcgcgcugauggacugcaucauguucgacgccgccguguccggcggccugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6139 - RNA, 1892 nt, Artificial Sequence
  mRNA product Design3 comprising derived and/or modified sequence from Lassa virus__AIT17299__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagggggcccggacgggccgcgacgggguggugcgggucugggacgugaagaacgccgagcuccugaacaaccaguucggcaccaugccgucccugacccucgccugccugaccaagcagggccagguggaccugaacgacgucgugcaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccguggucgaccucgaguccgacggcaagccccagaaggccggcagcaacaacuccaacaagagccugcaguccgcgggguucaccgccggccugacguacagccagcucaugacccugaaggacgccaugcugcagcuggacccgaacgccaagaccuggauggacaucgaggggcgccccgaggaccccguggagaucgcccucuaccagcccuccagcggcugcuacauccacuucuuccgggagccguccgaccugaagcaguucaagcaggacgcgaaguacagccacgggaucgacgugaccgaccuguucgccgcccagcccggccucacguccgccgucaucgacgcccugccccgcaacauggugaucacgugccagggcagcgacgacauccgcaagcuguucgagagccaggggcggaaggacaucaagcucaucgacaucgcgcuguccaagaccgacagccgcaaguacgagaacgccgucugggaccaguacaaggaccugugccacaugcacaccggcgugguggucgagaagaagaagcgcgggggcaaggaggagaucaccccgcacugcgcccucauggacugcaucauguucgacgccgcgguguccgggggccugaacagccuggugcuccgggccguccugccccgggacaugguguuccgcaccuccacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6140 - RNA, 1892 nt, Artificial Sequence
  mRNA product Design3 comprising derived and/or modified sequence from Lassa virus__AIT17303__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcugguccagagccaccccauccugaacaugaucgacaccaagaaguccagccucaacaucagcggcuacaacuucucccugggggccgccgugaaggccggcgccugcaugcuggacgggggcaacaugcucgagaccaucaaggugagcccccagaccauggacggcauccugaaguccauccugaaggucaagaaggcgcucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaaggccggcuccaacaacagcaacaagucccugcagagcgccggguucacggcgggccugaccuacucccagcucaugacccugaaggacagcaugcugcagcuggacccgaacgccaagaccuggauggacaucgaggggcggcccgaggaccccguggaggucgcccucuaccagcccuccagcggcugcuacauccacuucuuccgcgagccgacggaccugaagcaguucaagcaggacgccaaguacucccacgggaucgacgugaccgaccuguucgccgcgcagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaagacccucgugcugcgggccgugcugccgcgcgacauggucuuccggaccagcacccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6141 - RNA, 1892 nt, Artificial Sequence
  mRNA product Design3 comprising derived and/or modified sequence from Lassa virus__AIT17307__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacgcugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggacgggccgcgacggggucgugcgggugugggacgucaagaacgccgagcuccugaacaaccaguucggcaccaugccgucccugacccucgccugccugaccaagcagggccagguggaccugaacgacgugguccaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgugguggaccucgaguccgacggcaagcugcagaagaccggcagcaacaacuccaacaagagccugcaguccgccggguucacggcgggccucaccuacagccagcugaugacccugaaggacgccaugcugcagcucgaccccaacgccaagaucuggauggacaucgaggggcgcccggaggaccccgucgagaucgcccuguaccagcccuccagcggcugcuacauccacuucuuccgggagcccaccgaccugaagcaguucaagcaggacgccaaguacucccacgggaucgacgugacggaccucuucgcggcccagccgggccugaccagcgccgugaucgacgcccugccccgcaacauggucaucacgugccagggcuccgacgacauccgcaagcuccuggagagccaggggcggaaggacaucaagcugaucgacaucgcccucaacaagaccgacagccgcaaguacgagaacgcggugugggaccaguacaaggaccugugccacaugcacaccggcgucgugguggagaagaagaagaagggcgggaaggaggagaucacgccccacugcgcccugauggacugcaucauguucgacgccgccgucuccgggggccucaacaccagcgugcugcgggcggugcugccccgcgacauggucuuccggaccuccaccccgcgcguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6142 - RNA, 1892 nt, Artificial Sequence
  mRNA product Design3 comprising derived and/or modified sequence from Lassa virus__AIT17311__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacggucguggaccucgagagcgacggcaagccccagaaggccggcuccaacgggagcaacaagucccugcagagcgccggcuucaccgccgggcugaccuacucccagcucaugacccugaaggacgccaugcugcagcuggacccgaacgcgaagacguggauggacaucgagggccgccccgaggaccccguggaggucgcccucuaccagcccagcuccgggugcuacauccacuucuuccgggagccgaccgaccugaagcaguucaagcaggacgccaaguacagccacggcaucgacgugaccgaccuguucgccgcccagcccggccucaccuccgcggugaucgacgcccugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucgucguggagaagaagaagcggggcgggaaggaggagaucacgccccacugcgcgcugauggacugcaucauguucgacgccgccguguccggcggccugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6143 - RNA, 1892 nt, Artificial Sequence
  mRNA product Design3 comprising derived and/or modified sequence from Lassa virus__AIT17315__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgucgugcgggugugggacgucaagaacguggagcuccugaacaaccaguucgggacgaugccgucccugacccucgccugccugaccaagcagggccagguggaccugaacgacgcgguccaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgacaccccgggggagcggaaccccuacgagaacauccuguacaagaucugccugagcggcgacggguggcccuacaucgccucccgcaccagcaucacgggccgggccugggagaacaccgugguggaccucgaguccgacgggaagccccagaaggcgggcagcaacuccagcaacaagucccugcagagcgccggcuucaccgccgggcugaccuacucccagcucaugacgcugaaggacgccaugcugcagcuggacccgaacgccaagaccuggauggacaucgagggccgccccgaggaccccgucgagaucgcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgugaucgacgcgcugccccgcaacauggucaucacgugccagggcagcgacgacauccgcaagcugcucgagagccagggccggaaggacaucaagcugaucgacaucgcccuguccaagaccgacagccgcaaguacgagaacgccgugugggaccaguacaaggaccucugccacaugcacaccgggaucgucguggagaagaagaagaagggcuccaaggaggagaucaccccgcacugcgcccugauggacugcaucauguucgacgcggccgugagcgggggccugaacgccuccguccuccgggccgugcugccccgcgacaugguguuccggaccagcacgccccgcgucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6144 - RNA, 1892 nt, Artificial Sequence
  mRNA product Design3 comprising derived and/or modified sequence from Lassa virus__AIT17319__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggacaugcucaacaaccaguucggcaccaugccgagccugacgcuggccugccucaccaagcaggggcaggucgaccugaacgacguggugcaggcccugaccgaccucggccugaucuacaccgcgaaguaccccaacacguccgaccuggaccggcucgcccagagccaccccauccugaacaugaucgacaccaagaaguccagccugaacaucagcggcuacaacuucucccucggggccgccgucaaggccggcgcgugcaugcuggacgggggcaacaugcuggagaccaucaaggugagcccccagaccauggacggcauccucaaguccauccugaaggugaagaaggcccuggggauguucaucagcgagacgccgggcgagcgcaaccccuacgagaacauccucuacaagaucugccuguccggggacggcuggcccuacaucgccagccggaccuccaucaccgggcgcgccugggagaacaccaucgucgaccuggagagcgacggcaagccccagaaggccggcuccaacaacagcaacaagucccuccagagcgcgggguucacggccggccugaccuacucccagcugaugacccucaaggacagcaugcugcagcuggacccgaacgccaagaccuggauggacaucgaggggcggcccgaggaccccguggagguggcccuguaccagcccuccagcggcugcuacauccacuucuuccgcgagccgacggaccucaagcaguucaagcaggacgccaaguacucccacgggaucgacgucaccgaccuguucgcggcccagcccggccugaccagcgccgugaucgaggcccucccccggaacauggucaucacgugccagggcagcgacgacauccgcaagcugcuggagucccaggggcgcaaggacaucaagcucaucgacaucgugcugaacaagaccgacagccggaaguacgagaacgccgugugggaccaguacaaggaccugugccacaugcacaccggcgucgugguggagaagaagaagcgcgggggcaaggaggagaucacgccccacugcgcgcucauggacugcaucauguucgacgccgccgucuccgggggccugaagaccauggugcugcgggccgugcucccgcgcgacauggucuuccggaccagcacccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6145 - RNA, 1892 nt, Artificial Sequence
  mRNA product Design3 comprising derived and/or modified sequence from Lassa virus__AIT17323__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcuggcccagagccaccccauccugaacaugaucgacaccaagaaguccagccucaacaucagcggcuacaacuucucccugggggccgccgucaaggccggcgcgugcaugcuggacgggggcaacaugcucgagaccaucaaggugagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucgucgaccucgagagcgacggcaagccccagaaggccggcuccaacaacagcaacaagucccugcagagcgcgggguucacggccggccugaccuacucccagcucaugacccugaaggacagcaugcugcagcuggacccgaacgccaagaccuggauggacaucgaggggcggcccgaggaccccguggagguggcccucuaccagcccuccagcggcugcuacauccacuucuuccgcgagccgacggaccugaagcaguucaagcaggacgccaaguacucccacgggaucgacgucaccgaccuguucgcggcccagcccggccucaccagcgccgugaucgaggcccugccccggaacauggucaucacgugccagggcagcgacgacauccgcaagcugcucgagucccaggggcgcaaggacaucaagcugaucgacaucgcccugaacaagaccgacagccggaaguacgagaacgcggugugggaccaguacaaggaccucugccacaugcacaccggcguggucguggagaagaagaagcgcgggggcaaggaggagaucacgccccacugcgcccugauggacugcaucauguucgacgccgccguguccgggggccugaagacccucguccugcgggcggugcugccgcgcgacaugguguuccggaccagcacccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6146 - RNA, 1892 nt, Artificial Sequence
  mRNA product Design3 comprising derived and/or modified sequence from Lassa virus__AIT17325__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcugaacaugaucgggaugacgggcggcucccgcggggcccaggccggcggggacggcguggugcgggucugggacgugaagaacgccgaccuccugaacaaccaguucgggaccaugccgagccugacccucgcgugccugaccaagcagggccagguggaccugaacgacgucgugcaggcccucacggaccugggccugaucuacaccgccaaguaccccaacaccuccgaccucgaccggcugacccagagccaccccauccugaacaugaucgacacgaagaaguccagccucaacaucagcggguacaacuucucccugggcgccgccgugaaggcgggggccugcaugcuggacggcggcaacaugcucgagaccaucaaggucagcccccagaccauggacgggauccugaaguccauccugaaggugaagaagucccucggcauguucaucagcgacaccccgggggagcgcaaccccuacgagaacauccuguacaagaucugccugagcggcgacggguggcccuacaucgccucccggacgagcaucaccggccgcgccugggagaacaccguggucgaccucgaguccgacggcaagccccagaaggccgggggcaacaacagcaacaagucccugcagagcgcgggguucaccgccggccugacguacucccagcucaugacccugaaggacaccaugcugcagcuggacccgaacgccaagaccuggauggacaucgaggggcggcccgaggaccccguggagguggcccucuaccagcccagcuccggcugcuacauccacuucuuccgcgagccgacggaccugaagcaguucaagcaggacgccaaguacagccacggcaucgacgucaccgaccuguucgcggcccagcccgggcucaccuccgccgugaucgaggcccugccccggaacauggucaucacgugccagggcagcgacgacauccgcaagcugcucgagucccaggggcgcaaggacaucaagcugaucgacaucgcccugagcaagguggacagccggaaguacgagaacgcggugugggaccaguacaaggaccucugccacaugcacaccggcgucgugguggagaagaagaagcgcgggggcaaggaggagaucacgccccacugcgcccugauggacugcaucauguucgacgccgccgucuccggcgggcugaacacccucgugcugcgggcggugcugccgcgcgacauggucuuccggaccagcacccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6147 - RNA, 1892 nt, Artificial Sequence
  mRNA product Design3 comprising derived and/or modified sequence from Lassa virus__AIT17329__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccagaccgucaacaaccugguggagcugaaguccacccagcagaaguccauccuccgcgugggcacccugaccagcgacgaccugcucauccuggccgccgaccuggagaagcucaagagcaaggucauccggaccgagcgcccccuguccgccgggguguacaugggcaaccugagcucccagcagcucgaccagcggcgcgcccugcugaacaugaucgggaugagcuccggcaaccagggcgcgcaggccgggcgggacggcgugguccgcgugugggacgugaagaacgccgagcuccugaacaaccaguucgggacgaugccgagccugacccucgccugccugaccaagcagggccaggucgaccugaacgacgcggugcaggcccucaccgaccuggggcugaucuacacggccaaguaccccaacaccuccgaccucgaccggcugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggucagcccccagaccauggacggcauccugaaguccauccugaaggugaagaaggcccucggcauguucaucagcgacaccccgggggagcgcaaccccuacgagaacauccuguacaagaucugccuguccggcgacggguggcccuacaucgccagccggaccuccaucacgggccgcgccugggagaacaccguggucgaccucgagagcgacgggaugccccagaaggcgggcuccagcuccagcaacaagucccugcagagcgccggcuucguggccgggcugaccuacucccagcucaugacccugaaggacgccaugcugcagcuggacccgaacgccaagacguggauggacaucgagggccggcccgaggaccccguggagaucgcgcucuaccagcccagcuccgggugcuacauccacuucuuccgcgagccgaccgaccugaagcaguucaagcaggacgccaaguacagccacggcaucgacgucaccgaccuguucgccgcccagcccgggcucaccagcgccgugaucgacgcgcugccccggaacauggugaucacgugccagggcuccgacgacauccgcaagcugcucgagagccagggccgcaaggacaucaagcugaucgacaucgcccuguccaaggccgacagccggaaguacgagaacgccgucugggaccaguacaaggaccucugccacaugcacaccgggguggucguggagaagaagaagcgcggcgggaaggaggagaucacgccccacugcgcgcugauggacugcaucauguacgacgccgccguguccggcgggcugaacaccagcguccuccgggccgugcugccgcgcgacaugguguuccggaccuccacgccccgcgucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6148 - RNA, 1892 nt, Artificial Sequence
  mRNA product Design3 comprising derived and/or modified sequence from Lassa virus__AIT17333__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggaucguggucgagaagaagaagcggggcgggaaggaggagaucacgccccacugcgcccugauggacugcaucauguucgacgccgccgugagcggcgggcugaacaccuccgugcuccgcgccguccugccgcgggacaugguguuccgcaccagcacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6149 - RNA, 1892 nt, Artificial Sequence
  mRNA product Design3 comprising derived and/or modified sequence from Lassa virus__AIT17335__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccauccuccgcgugggcacccugaccuccgacgaccugcucauccuggccgccgaccuggagaagcucaagagcaaggucacccggaccgagcgcccccuguccgccgggguguacaugggcaaccugagcucccagcagcucgaccagcggcgcgcgcugcugagcaugaucgggauguccagcggcgugcagggcgcccgggccgggcgcgacggcgucgugcgggugugggacgucaagaacgccgagcuccugaacaaccaguucgggacgaugccgucccugacccucgcgugccugaccaagcagggccagguggaccugaacgacgugguccaggcccucaccgaccuggggcugaucuacacggccaaguaccccaacaccagcgaccucgaccgccugacccagagccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgagaccccgggggagcggaaccccuacgagaacauccuguacaagaucugccugagcggcgacggguggcccuacaucgccucccgcaccagcaucacgggccgggccugggagaacaccgugguggaccucgaguccgacgggaagccccagaaggcgggcagcaacaacuccaacaagagccugcaguccaccggcuucgccgccgggcugaccuacagccagcucaugacgcugaaggacgccaugcugcagcuggacccgaacgccaagaccuggauggacaucgagggccgccccgaggaccccgucgagguggcgcucuaccagcccuccagcgggugcuacauccacuucuuccgggagccgaccgaccugaagcaguucaagcaggacgccaaguacucccacggcaucgacgugaccgaccuguucgccgcccagcccgggcucacgagcgccgucaucgacgcgcugccccgcaacauggugaucacgugccagggcagcgacgacaucaagaagcugcucgagucccagggccgcaaggacaucaagcugaucgacaucgcccugagcaagaccgacucccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccgugagcggcgggcugaacaccuccgugcuccgggccguccugccccgcgacaugguguuccggaccagcacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6150 - RNA, 1892 nt, Artificial Sequence
  mRNA product Design3 comprising derived and/or modified sequence from Lassa virus__AIT17341__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaaguccauccugaaggugaagaaggcccucgggauguucaucagcgacgccccgggcgagcggaaccccuacgagaacauccuguacaagaucugccuguccggggacggcuggcccuacaucgcgagccgcaccuccaucaccgggcgggccugggagaacacgguggucgaccucgagagcgacggcaagccccagaaggccggcuccaacgggagcaacaagucccugcagagcgccggcuucaccgccgggcugaccuacucccagcucaugacccugaaggacgcgaugcugcagcuggacccgaacgccaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccgcgcagcccggccucaccuccgccgucaucgacgcccugccccgcaacauggugaucacgugccaggggagcgacgacauccgcaagcuguucgagucccagggccggaaggacaucaagcucaucgacaucgcccugagcaaggcggacagccgcaaguacgagaacgccgugugggaccaguacaaggaccugugccacaugcacaccggggucguggucgagaagaagaagcggggcgggaaggaggagaucacgccccacugcgcccucauggacugcaucauguucgacgccgccguguccggcggccugaacaccagcgugcugcgcgcgguccucccgcgggacaugguguuccgcaccuccacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6151 - RNA, 1892 nt, Artificial Sequence
  mRNA product Design3 comprising derived and/or modified sequence from Lassa virus__AIT17345__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcuccggcgugcagggcgcccgggccgggcgcgacggcgucgugcgggugugggacgucaagaacgccgagcuccugaacaaccaguucgggacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggugagcccccagaccauggacggcauccugaaguccauccugaaggucaagaaggcccucggcauguucaucagcgagaccccgggggagcggaaccccuacgagaacauccuguacaagaucugccuguccggcgacggguggcccuacaucgccagccgcaccuccaucacgggccgggccugggagaacaccgugguggaccucgagagcgacgggaagccccagaaggcgggcuccaacaacagcaacaagucccugcagagcgccggcuucaccgccgggcugaccuacucccagcucaugacgcugaaggacgccaugcugcagcuggacccgaacgccaagaccuggauggacaucgagggccgccccgaggaccccgucgagguggcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgucaucgacgcgcugccccgcaacauggugaucacgugccagggcagcgacgacaucaagaagcugcucgagagccagggccgcaaggacaucaagcugaucgacaucgcccuguccaagaccgacagccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccguguccggcgggcugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6152 - RNA, 1892 nt, Artificial Sequence
  mRNA product Design3 comprising derived and/or modified sequence from Lassa virus__AIT17351__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcucaagagcacccagcagaaguccgugcugcgcgucgggacccugaccagcgacgaccugcucauccuggccgccgaccuggagaagcucaaguccaaggugauccggaccgagcgcccccugagcgccggcguguacauggggaaccuguccagccagcagcucgagcagcggcgcgcgcugcugaacaugaucggcauguccagcggcaaccagggggcccggaccggcaaggacggggucgugcgcaucugggacgugaagaacgccgaccuccugaacaaccaguucggcaccaugccgucccugacccucgccugccugaccaagcaggggcaggucgaccugaacgacguggugcaggcgcucaccgaccugggccugaucuacacggccaaguaccccaacaccagcgaccucgaccggcugacccagucccaccccauccugaacauggucgacaccagcaagagcucccucaacaucagcggcuacaacuucucccugggggccgccgugaaggccggcgcgugcaugcuggacgggggcaacaugcucgagacgaucaaggugagcccccagaccauggacggcauccugaaguccauccugaaggucaagaagucccucgggauguucgugagcgacaccccgggcgagcgcaaccccuacgagaacauccuguacaagaucugccugagcggggacggcuggcccuacaucgccucccggaccagcaucacggggcgcgccugggagaacaccguggucgaccucgaguccaacggcaagccccagaaggccggcagcaacaacuccaacaagagccugcaguccaccggguucaccgccggccugacguacagccagcucaugacccugaaggacgcgaugcugcagcuggacccgaacgccaagaccuggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugacggaccuguucgccgcgcagcccggccucaccagcgccgucaucgacacccugccccggaacauggugaucacgugccagggcagcgacgacauccgcaagcugcucgagucccaggggcgcaaggacaucaagcugaucgacaucgcccugagcaagaucgacucccggaaguacgagaacgccgucugggaccaguacaaggaccucugccacaugcacaccggcgugguggucgagaagaagaagcgcgggggcaaggaggagaucacgccccacugcgcccugauggacugcaucauguucgacgcggccgugagcgggggccugaacgccuccgugcuccgggccguccugccgcgcgacaugguguuccggaccagcacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6153 - RNA, 1892 nt, Artificial Sequence
  mRNA product Design3 comprising derived and/or modified sequence from Lassa virus__AIT17359__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccauccuccgcgugggcacccugaccagcgacgaccugcucauccuggccgccgaccuggagaagcucaagagcaaggucacccggaccgagcgcccccuguccgccgggguguacaugggcaaccugagcucccagcagcucgaccagcggcgcgcgcugcugaacaugcucgggaugagcggcuccaaccagggcgcccgggccgggcgcgacggcgugguccgggugugggacgugaagaacgccgagcugcugaacaaccaguucgggacgaugccgagccucacccuggcgugccugaccaagcagggccaggucgaccucaacgacgccgugcaggcccugaccgaccuggggcucaucuacacggccaaguaccccaacaccuccgaccuggaccgccugacccagagccaccccauccucaacaugaucgacaccaagaaguccagccugaacaucagcggcuacaacuucucccugggcgccgcggugaaggccggggccugcaugcucgacggcgggaacaugcuggagacgaucaaggucagcccccagaccauggacggcauccugaaguccauccucaaggugaagaaggcccugggcauguucaucagcgacaccccgggggagcggaaccccuacgagaacauccuguacaagaucugccucuccggcgacggguggcccuacaucgccagccgcaccuccaucacgggccgggcgugggagaacaccguggucgaccuggagagcgacgagaagccccagaaggccggguccaacagcuccaacaagagccugcaguccgccggcuucaccgccggccucaccuacagccagcugaugacgcugaaggacgccaugcugcagcucgacccgaacgcgaagaccuggauggacaucgaggggcgccccgaggaccccguggagaucgcccuguaccagcccuccagcggcugcuacauccacuucuuccgggagccgaccgaccugaagcaguucaagcaggacgccaaguacucccacgggaucgacgugaccgaccucuucgccgcccagcccggccugacgagcgcggucaucgacgcccugccccgcaacauggugaucacgugccaggggagcgacgacauccgcaagcuccuggagucccagggccggaaggacaucaagcugaucgacaucgcccucagcaagaccgacucccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucagcgggggccucaacgccuccgugcugcgggccgugcugccccgggacauggucuuccgcaccagcacgccccggguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6154 - RNA, 1892 nt, Artificial Sequence
  mRNA product Design3 comprising derived and/or modified sequence from Lassa virus__AIT17361__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccuccgacgaccugcucgugcuggccgccgaccuggagaagcucaagagcaaggugacccggaccgagcgcccccuguccgccggggucuacaugggcaaccugagcucccagcagcucgaccagcggcgcgcgcugcugaacaugaucgggaugagcggcggcaaccagggggcccgggccggccgcgacgggguggugcggaucugggacgucaagaacgccgagcuccugaacaaccaguucggcacgaugccgucccugacccucgcgugccugaccaagcagggccagguggaccugaacgacgugguccaggcccucaccgaccuggggcugaucuacacggccaaguaccccaacaccagcgaccucgaccgccugacccagucccaccccauccugaacaugaucgacaccaagaaguccagccucaacaucagcggcuacaacuucagccugggggccgccgugaaggcgggcgccugcaugcuggacgggggcaacaugcucgagacgaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccaucguggaccucgaguccgacggcaagccccagaagaccaacaacaccaacagcaacaagucccugcagagcgcgggcuucgccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgucacggaccuguucgccgcccagcccgggcucaccuccgccgugaucgacacccugccccgcaacauggugaucacgugccagggcagcgaggacauccgccggcugcucgagucccagggccgcaaggacaucaagcugaucgacaucgcgcugagcaagaccgacagccggaaguacgagaacgccgucugggaccaguacaaggaccucugccacaugcacaccgggguggucguggagaagaagaagaagggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6155 - RNA, 1892 nt, Artificial Sequence
  mRNA product Design3 comprising derived and/or modified sequence from Lassa virus__AIT17365__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccaggccgggcgggacggcgugguccgcgugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgcgucccggaccagcaucaccggccgcgccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugaccgaccuguucgccgcgcagcccggccucaccagcgccgucaucgacgcccugccccggaacauggugaucacgugccagggcuccgacgacauccgcaagcuguucgagagccaggggcgcaaggacaucaagcucaucgacaucgcccugagcaagaccgacucccggaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgcgacauggucuuccggaccagcacgccccgcguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6156 - RNA, 1892 nt, Artificial Sequence
  mRNA product Design3 comprising derived and/or modified sequence from Lassa virus__AIT17371__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccaggccgggcgggacggcgugguccgcgugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgcgucccggaccagcaucaccggccgcgccugggagaacacgguggucgaccucgaguccgacgggaagccccagaaggccggcagcaacuccagcaacaagucccugcagagcgccggcuucaccgccgggcugaccuacucccagcucaugacccugaaggacgcgaugcugcagcuggacccgaacgccaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccgcgcagcccgggcucaccuccgccgucaucgacgcccugccccggaacauggugaucacgugccagggcagcgacgacauccgcaagcuguucgagagccagggccgcaaggacaucaagcucaucgacaucgcccuguccaagaccgacagccggaaguacgagaacgcggugugggaccaguacaaggaccugugccacaugcacaccgggaucgucguggagaagaagaagcgcggcgggaaggaggagaucacgccccacugcgcccucauggacugcaucauguucgacgccgccgucuccggcgggcugaacaccagcgugcugcgggccgugcucccgcgcgacauggucuuccggaccuccacgccccgcguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6157 - RNA, 1892 nt, Artificial Sequence
  mRNA product Design3 comprising derived and/or modified sequence from Lassa virus__AIT17379__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccagcgacgaccugcucauccuggccgccgaccuggagaagcucaagagcaaggugacccggaccgagcgcccccuguccgccgggguguacaugggcaaccugagcucccagcagcucgaccagcggcgcgcgcugcugaacaugaucgggaugagcuccggcaaccggggcgcccaggccgggcgcgacggcgucgugcgggugugggacgucaagaacgccgagcuccugaacaaccaguucgggacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacauggucgacaccaagaaguccagccucaacaucagcggcuacaacuucucccugggcgccgcggugaaggccggggccugcaugcuggacggcgggaacaugcucgagacgaucaaggugagcccccagaccauggacggcauccugaaguccauccugaaggucaagaaggcccucggcauguucaucagcgacaccccgggggagcggaaccccuacgagaacauccuguacaagaucugccuguccggcgacggguggcccuacaucgccagccgcaccuccaucacgggccgggcgugggagaacaccgugguggaccucgagagcgacgggaagccccagaaggccggcuccaacaacagcaacaagucccugcagagcgccggcuucgccgccgggcugaccuacucccagcucaugacccugaaggacgcgaugcugcagcuggacccgaacgccaagacguggauggacaucgagggccgccccgaggaccccgucgagaucgcccucuaccagcccagcuccgggugcuacauccacuucuuccgggagccgaccgaccugaagcaguucaagcaggacgccaaguacagccacggcaucgacgugaccgaccuguucgccgcgcagcccgggcucaccuccgccgugaucgacgcccugccccgcaacauggucaucacgugccagggcagcgacgacauccgcaagcugcucgagagccagggccggaaggacaucaagcugaucgacaucgcccuguccaagaccgacagccgcaaguacgagaacgcggugugggaccaguacaaggaccucugccacaugcacaccgggaucgucguggagaagaagaagcggggcgggaaggaggagaucacgccccacugcgcccugauggacugcaucauguucgacgccgccguguccggcgggcugaacaccagcguccuccgcgccgugcugccgcgggacaugguguuccgcaccuccacgccccgggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6158 - RNA, 1892 nt, Artificial Sequence
  mRNA product Design3 comprising derived and/or modified sequence from Lassa virus__AIT17381__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggcccgggccggccgcgacgggguggugcggaucugggacgucaagaacgccgagcuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccuccaacaccaacagcaacaagucccugcagagcgcgggcuucgccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgucacggaccuguucgccgcccagcccgggcucaccuccgccgugaucgacgcgcugccccgcaacauggugaucacgugccagggcagcgaggacauccgcaagcugcucgagagccagggccggaaggacaucaagcugaucgacaucgcccuguccaagaccgacagccgcaaguacgagaacgccgucugggaccaguacaaggaccucugccacaugcacaccgggguggucguggagaagaagaagaagggcgggaaggaggagaucaccccgcacugcgcccugauggacugcaucauguucgacgcggccguguccggcgggcugaacaccagcguccuccgggccgugcugccccgcgacaugguguuccggaccuccacgccccgcgucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6159 - RNA, 1892 nt, Artificial Sequence
  mRNA product Design3 comprising derived and/or modified sequence from Lassa virus__AIT17389__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcugaaguccacccagcagaaguccgugcuccgcgucgggacccugaccagcgacgaccugcucauccuggccgccgaccuggagaagcucaaguccaaggugacccggaccgagcgcccccugagcgccggcguguacauggggaaccuguccagccagcagcucgaccagcggcgcgcgcugcugaacaugaucggcauguccggcgggaaccagggcgcccggacggggaaggacggcgucgugcgcaucugggacgugaagaacgccgaccuccugaacaaccaguucgggaccaugccgagccugacccucgccugccugaccaagcagggccaggucgaccugaacgacguggugcaggcgcucacggaccugggccugaucuacaccgccaaguaccccaacaccuccgaccucgaccggcugacccagagccaccccauccugaacaugaucgacacguccaagagcagccucaacaucuccggguacaacuucagccugggcgccgccgucaaggccggggcgugcaugcuggacggcggcaacaugcucgagaccaucaaggugagcccccagaccauggacgggauccucaagagcauccugaaggugaagaagucccugggcauguucaucagcgacaccccgggggagcgcaaccccuacgagaacauccuguacaagaucugccuguccggcgacggguggcccuacaucgccagccggacguccaucaccggccgcgccugggagaacaccgucguggaccucgagagcgacggcaagccccagaaggccggguccaacaacagcaacaagucccugcagagcaccggcuucacggccgggcugaccuacucccagcucaugacccugaaggacgcgaugcugcagcuggacccgaacgccaagaccuggauggacaucgagggccggcccgaggaccccguggagaucgcccucuaccagcccagcuccgggugcuacauccacuucuuccgcgagccgacggaccugaagcaguucaagcaggacgccaaguacagccacggcaucgacgucaccgaccuguucgccgcgcagcccggccucaccuccgccgugaucgacacccugccccggaacauggugaucacgugccaggggagcgacgacauccgcaagcugcucgagagccagggccgcaaggacaucaagcugaucgacaucgcccuguccaagaccgacagccggaaguacgagaacgccgucugggaccaguacaaggaccucugccacaugcacaccgggguggucguggagaagaagaagcgcggcgggaaggaggagaucacgccccacugcgcccugauggacugcaucauguucgacgcggccguguccggcggccugaacgucagcgugcuccgggccgugcugccgcgcgacauggucuuccggaccuccacgccccgcguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6160 - RNA, 1892 nt, Artificial Sequence
  mRNA product Design3 comprising derived and/or modified sequence from Lassa virus__AIT17399__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacccugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcuggcccagagccaccccauccugaacaugaucgacaccaagaaguccagccucaacaucagcggcuacaacuucucccugggggccgccgucaaggccggcgcgugcaugcuggacgggggcaacaugcucgagaccaucaaggugacgccccagaccauggacggcauccucaagagcauccugaaggugaagaaggcccuggggauguucaucuccgagaccccgggcgagcgcaaccccuacgagaacauccuguacaagaucugccugagcggggacggcuggcccuacaucgccucccggaccagcaucaccgggcgcgccugggagaacacggucguggaccucgaguccgacggcaagccccagaaggccggcaacaacaacagcaacaagucccugcagagcgcgggguucaccgccggccugaccuacucccagcucaugacccugaaggacagcaugcugcagcuggacccgaacgccaagacguggauggacaucgaggggcggcccgaggaccccguggaggucgcccucuaccagcccuccagcggcugcuacauccacuucuuccgcgagccgaccgaccugaagcaguucaagcaggacgccaaguacucccacgggaucgacgugaccgaccuguucgcgacccagcccggccucacgagcgccgucaucgaggcccugccccggaacauggugaucacgugccagggcuccgacgacauccgcaagcugcucgagagccaggggcgcaaggacaucaagcugaucgacaucgcccugaacaagaccgacagccggaaguacgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaagacccucgcccugcgggcggugcugccgcgcgacaugguguuccggaccagcacccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6161 - RNA, 1892 nt, Artificial Sequence
  mRNA product Design3 comprising derived and/or modified sequence from Lassa virus__AIT17405__NP (opt1)
gggagaaagcuuaccaugagcguguccaaggaggucaagagcuuccuguggacccagucccuccgccgggagcugagcggcuacugcuccaacaucaagcuccagguggugaaggacgcccaggcccugcugcacgggcuggacuucagcgaggucuccaacgugcagcgccucaugcggaagcagaagcgcgacgacagcgaccugaagcggcugcgcgaccucaaccaggcggugaacaaccuggucgagcugaaguccacccagcagaaguccauccuccgggugggcacccugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcccaggggacccagccgggccgcgacggggugguccgggugugggacgugaagaaccccgaccuccugaacaaccaguucggcaccaugcccagccugacccucgcgugccugacgaagcaggggcaggucgaccugaacgacgccgugcucgcccugaccgaccugggccucaucuacaccgccaaguaccccaacuccagcgaccuggaccgccugucccagagccacccgauccucaacaugguggacaucaagaaguccagccugaacaucagcggcuacaacuucucccugggggcggccgucaaggccggcgccugcaugcucgacgggggcaacaugcuggagaccaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgccagccggaccuccaucguggggcgcgcgugggagaacacgaccguggaccuggagagcgacggcaagccccagaaggucggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgcgaaguacucccacggcaucgacgucgccgaccuguucccggcccagcccggccucaccagcgccgugaucgaggcccugccccggaacauggugcugacgugccaggggagcgacgacaucaagcgccuccuggacucccagggccgccgggacaucaagcugaucgacaucgcgcucagcaaggccgacucccgccgguucgagaacgccgucugggaccagugcaaggaccugugccacaugcacaccggggugguggucgagaagaagaagcgcggcgggaaggaggagaucacgccccacugcgcccugauggacugcaucauguacgacgccgcggugagcggcggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6162 - RNA, 1892 nt, Artificial Sequence
  mRNA product Design3 comprising derived and/or modified sequence from Lassa virus__AIT17409__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucaacaaggccgacucccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgccgcggucagcggcgggcucaacauccccgugcugcgggccgugcugccgcgggacauggucuuccgcaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6163 - RNA, 1892 nt, Artificial Sequence
  mRNA product Design3 comprising derived and/or modified sequence from Lassa virus__AIT17413__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacgcgcccggcgagcgcaaccccuacgagaacauccuguacaagaucugccucagcggggacggcuggccguacaucgccucccggaccagcaucgucgggcgcgccugggagaacaccaccguggaccuggaguccgacggcaagccccagaagaugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6164 - RNA, 1892 nt, Artificial Sequence
  mRNA product Design3 comprising derived and/or modified sequence from Lassa virus__AIT17421__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucagcggcgcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaucaagaaguccagccugaacaucuccggcuacaacuucagccugggcgccgccgugaaggccggggccugcaugcucgacggcgggaacaugcuggagaccaucaaggucacgccccagaccauggacggcauccugaaguccauccucaaggugaagcggagccugggcauguucguguccgacacccccggggagcgcaaccccuacgagaacauccuguacaagaucugccucagcggcgacggguggccguacaucgcgucccggaccagcaucgucggccgcgccugggagaacacgaccguggaccuggaguccgacgggaagccccagaagaugggcagcgccggcuccaacaagagccugcaguccgccggguuccccaccggccucaccuacagccagcugaugacgcugaaggacuccaugaugcagcuggaccccagcgccaagaccuggaucgacaucgaggggcggccggaggaccccguggagaucgcgcucuaccagcccauguccggcugcuacauccacuucuuccgcgagcccaccgaccugaagcaguucaagcaggacgccaaguacagccacgggaucgacgucgccgaccuguucccggcccagcccggccucaccagcgccgugaucgaggcgcugccccggaacaugguccugacgugccagggcuccgacgacaucaagcgccuccuggacagccaggggcgccgggacaucaagcugaucgacaucgcccucuccaaggccgacagccgccgguucgagaacgccgugugggaccagugcaaggaccugugccacaugcacaccggcguggucguggagaagaagaagcgcgggggcaaggaggagaucacgccccacugcgcccugauggacugcaucauguacgacgcggccguguccgggggccucaacaucccgguccugcgggccgugcugccccgcgacaugguguuccggaccagcucccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6165 - RNA, 1892 nt, Artificial Sequence
  mRNA product Design3 comprising derived and/or modified sequence from Lassa virus__AIT17425__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagaagucccuggggauguucgugagcgacacccccggcgagcggaaccccuacgagaacauccuguacaagaucugccucagcggggacggcuggccguacaucgcgucccgcaccagcaucgucgggcgggccugggagaacaccaucguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccgucgagaucgcgcucuaccagcccaugagcgggugcuacauccacuucuuccgggagcccaccgaccugaagcaguucaagcaggacgccaaguacucccacggcaucgacguggccgaccuguucccggcccagcccggccucacgagcgccgucaucgaggcgcugccccgcaacauggugcugaccugccaggggagcgacgacaucaagcggcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6166 - RNA, 1892 nt, Artificial Sequence
  mRNA product Design3 comprising derived and/or modified sequence from Lassa virus__AIT17429__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuacaacuucucccugggggccgccgugaaggccggcgcgugcaugcucgacgggggcaacaugcuggagaccaucaaggucacgccccagaccauggacggcauccucaagagcauccugaaggugaagcggucccuggggauguucgugagcgacgcccccggcgagcgcaaccccuacgagaacauccuguacaagaucugccucuccggggacggcuggccguacaucgccagccggaccuccaucgucgggcgcgccugggagaacaccacgguggaccuggagagcgacggcaagccccagaaggugggcaccgccggguccaacaagagccugcaguccgcgggcuuccccaccgggcucaccuacagccagcugaugacgcugaaggacuccaugaugcagcuggaccccagcgccaagaccuggaucgacaucgagggccggccggaggaccccgucgagaucgcccucuaccagcccauguccgggugcuacauccacuucuuccgcgagcccaccgaccugaagcaguucaagcaggacgccaaguacagccacggcaucgacguggccgaccuguucccggcgcagcccggccucaccuccgccgucaucgaggcccugccccggaacauggugcugacgugccaggggagcgacgacaucaagcgccuccuggacagccagggccgccgggacaucaagcugaucgacaucgcccucuccaaggccgacagccgccgguucgagaacgcggugugggaccagugcaaggaccugugccacaugcacaccggggucgugguggagaagaagaagcgcggcgggaaggaggagaucacgccccacugcgcccugauggacugcaucauguacgacgccgccgucuccggcggccucaacaucccggugcugcgggcggugcugccccgcgacauggucuuccggaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6167 - RNA, 1892 nt, Artificial Sequence
  mRNA product Design3 comprising derived and/or modified sequence from Lassa virus__AIT17431__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuucaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccgccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6168 - RNA, 1892 nt, Artificial Sequence
  mRNA product Design3 comprising derived and/or modified sequence from Lassa virus__AIT17439__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuucaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccgucagcgggugcuacauccacuucuuccgcgagcccacggaccugaagcaguucaagcaggacgccaaguacucccacggcaucgacguggccgaccuguucagcgcccagccgggccucaccagcgccgucaucgaggcgcugccccggaacauggugcugaccugccagggguccgacgacaucaagcgccuccuggacagccagggccgccgggacaucaagcugaucgacaucgcccucuccaaggccgacagccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucuccggcggccucaacauccccguguuccgggccgugcugccgcgcgacauggucuuccggaccagcucccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6169 - RNA, 1892 nt, Artificial Sequence
  mRNA product Design3 comprising derived and/or modified sequence from Lassa virus__AIT17443__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacgcgcccggcgagcgcaaccccuacgagaacauccuguacaagaucugccucagcggggacggcuggccguacaucgccucccggaccagcaucgucgggcgcgccugggagaacaccaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcgcugauggacugcaucauguacgacgccgccgucagcggcggccucaacaucccggugcugcgcgccgugcugccccgggacauggucuuccgcaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6170 - RNA, 1892 nt, Artificial Sequence
  mRNA product Design3 comprising derived and/or modified sequence from Lassa virus__AIT17447__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacgugaccgaccuguucccggcccagcccggccucaccuccgccgucaucgaggcccugccccgcaacauggugcugacgugccaggggagcgacgacaucaagcggcuccuggacagccagggccgccgcgacaucaagcugaucgacaucgcccucuccaaggcggacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgccgccgucuccggcggccucaacaucccggugcugcgcgcggugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6171 - RNA, 1892 nt, Artificial Sequence
  mRNA product Design3 comprising derived and/or modified sequence from Lassa virus__AIT17451__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacguggccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6172 - RNA, 1892 nt, Artificial Sequence
  mRNA product Design3 comprising derived and/or modified sequence from Lassa virus__AIT17455__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcuguccaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccagcgccgugaucgaggcgcugccccggaacauggugcugaccugccagggguccgacgacaucaagcgccuccuggacagccagggccgccgggacaucaagcugaucgacaucgcccucuccaaggccgacagccgccgguucgagaacgccgucugggaccagugcaaggaccugugccacaugcacaccggggugguggucgagaagaagaagcgcggcgggaaggaggagaucacgccccacugcgcccugauggacugcaucauguacgacgcggccguguccggcggccucaacaucccggugcugcgggccguccugccccgcgacaugguguuccggaccagcucccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6173 - RNA, 1892 nt, Artificial Sequence
  mRNA product Design3 comprising derived and/or modified sequence from Lassa virus__AIT17459__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccgucagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6174 - RNA, 1892 nt, Artificial Sequence
  mRNA product Design3 comprising derived and/or modified sequence from Lassa virus__AIT17463__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcacaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaguccacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaccaugguggacacgaagaaguccagccugaacaucagcggcuucaacuucucccugggcgccgccgugaaggccggggccugcaugcucgacggcgggaacaugcuggagaccaucaaggucacgccccagaccauggacggcauccucaagagcauccugaaggugaagaagucccugggcauguucgugagcgacacccccggggagcggaaccccuacgagaacauccuguacaagaucugccucuccggcgacggguggccguacaucgcgagccgcaccuccaucgucggccgggccugggagaacaccaucguggaccuggagaccgacgggaagccccagaaggugggcacggccggcagcucccgcagccugcaguccgccggguuccccaccggccucaccuacagccagcugaugacccugaaggacuccaugaugcagcuggaccccagcgccaagacguggaucgacaucgaggggcggccggaggaccccgucgagaucgcgcucuaccagcccauguccggcugcuacauccacuucuuccgcgagcccaccgaccugaagcaguucaagcaggacgccaaguacagccacgggaucgacguggccgaccuguucccggcccagcccggccucaccagcgccgucaucgaggcgcugccccggaacauggugcugaccugccagggcuccgacgacaucaagaagcuccuggacagccaggggcgccgcgacaucaagcugaucgacaucgcccucuccaaggccgacagccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgcggccgucuccgggggccucaacaucccggugcugcgggccgugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6175 - RNA, 1892 nt, Artificial Sequence
  mRNA product Design3 comprising derived and/or modified sequence from Lassa virus__AIT17467__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcacccaggggacccagccgggccgcgacgggguggugcgggucugggacgugaagaaccccgaccuccugaacaaccaguucggcaccaugcccucccugacgcucgcgugccugaccaagcagggccagguggaccugaacgacgccguccucgcccugaccgaccuggggcucaucuacaccgccaaguaccccaacagcuccgaccuggaccgccugagccagagccacccgauccucaacaugguggacacgaagaaguccagccugaacaucuccggcuacaacuucagccugggggcggccgugaaggccggcgccugcaugcucgacgggggcaacaugcuggagaccaucaaggucacgccccagaccauggacggcauccugaaguccauccucaaggugaagaagucccuggggauguucgugagcgacacccccggcgagcggaaccccuacgagaacauccuguacaagaucugccucagcggggacggcuggccguacaucgccucccgcaccagcaucgucgggcgggcgugggagaacaccaccguggaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacguggccgaccuguucccggcccagcccggccucaccagcgccgucaucgaggcccugccccgcaacauggugcugaccugccaggggagcgacgacaucaagcggcuccuggacucccagggccgccgcgacaucaagcugaucgacaucagccucuccaaggcggacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgccgucuccggcggccucaacaucccggugcugcgcgcggugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6176 - RNA, 1892 nt, Artificial Sequence
  mRNA product Design3 comprising derived and/or modified sequence from Lassa virus__AIT17471__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccacggggagcaacaagucccugcagagcgccggcuuccccaccgggcucaccuacucccagcugaugacccugaaggacagcaugaugcagcuggaccccuccgccaagacguggaucgacaucgagggccggccggaggaccccguggagaucgcccucuaccagcccaugagcgggugcuacauccacuucuuccgcgagcccaccgaccugaagcaguucaagcaggacgcgaaguacucccacggcaucgacgucgccgaccuguucccggcccagcccggccucaccagcgccgugaucgaggcccugccccggaacaugguccugaccugccaggggagcgacgacaucaagaagcuccuggacucccagggccgccgcgacaucaagcugaucgacaucgcgcucagcaaggccgacucccggaaguucgagaacguggugugggaccagugcaaggaccugugccacaugcacacgggggucgugguggagaagaagaagcgcggcgggaaggaggagaucacgccccacugcgcccugauggacugcaucauguacgacgccgccgucagcggcggccucaacaucccggugcugcgggcggugcugccccgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6177 - RNA, 1892 nt, Artificial Sequence
  mRNA product Design3 comprising derived and/or modified sequence from Lassa virus__AIT17475__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcgcccagcagcucgagcagcgccgggcgcugcuguccaugaucgggauggugggcggcgcccaggggacgcagccgggccgcgacggggugguccgggugugggacgugaagaaccccgaccuccugaacaaccaguucggcaccaugcccagccugacccucgccugccugaccaagcaggggcaggucgaccugaacgacacggugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccaucuccgggugcuacauccacuucuuccgcgagcccacggaccugaagcaguucaagcaggacgccaaguacagccacggcaucgacgucaccgaccuguucccggcccagcccggccucaccagcgccgugaucgaggcccugccccggaacauggugcugaccugccagggguccgacgacaucaagcgccuccuggacagccagggccgccgggacaucaagaucaucgacaucgcgcuguccaaggccgacagccgccgguucgagaacgccgucugggaccagugcaaggaccucugccacaugcacacgggggugguggucgagaagaagaagcgcggcgggaaggaggagaucacgccccacugcgcccugauggacugcaucauguacgacgccgcgguguccggcggccugaacaucccggugcuccgggccguccugccccgcgacaugguguuccggaccagcucccccaaggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6178 - RNA, 1892 nt, Artificial Sequence
  mRNA product Design3 comprising derived and/or modified sequence from Lassa virus__AIT17479__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccgggugggcacgcugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugucccagagccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccuccgccgugaucgaggcgcugccccggaacauggugcugaccugccaggggagcgacgacaucaagaagcuccuggacagccagggccgcaaggacaucaagcugaucgacaucgcccucuccaaggucgacagccgccgguucgagaacgccgugugggaccagugcaaggaccugugccacaugcacaccgggguggucguggagaagaagaagcgcggcgggaaggaggagaucacgccccacugcgcccugauggacugcaucauguacgacgccgcgguguccggcggccucaacaucccgguccugcgggccgugcugccccgcgacaugguguuccggaccagcucccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6179 - RNA, 1892 nt, Artificial Sequence
  mRNA product Design3 comprising derived and/or modified sequence from Lassa virus__AIT17491__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacgcugaccagcgacgaccugcucacccuggccgccgaccuggagaagcucaaguccaaggugauccgcaccgagcggccccugagcuccggcgucuacauggggaaccugagcacgcagcagcucgagcagcgccgggcccugcuguccaugaucggcauggugggcggggcgcgcggcacccagccggggcgggacggcgugguccgcgugugggacgugaagaaccccgaccuccugaacaaccaguucgggaccaugcccagccugacccucgccugccugacgaagcagggccaggucgaccugaacgacguggugcucgcccugaccgaccugggccucaucuacaccgccaaguaccccaacuccagcgaccuggaccggcugucccagagccacccgauccucaacauggucgacaccaagaaguccagccugaacaucagcggguacaacuucucccugggcgcggccgugaaggccggggccugcaugcucgacggcggcaacaugcuggagacgaucaaggugacgccccagaccauggacgggauccucaagagcauccugaaggucaagaagucccugggcauguucgugagcgacacccccggggagcgcaaccccuacgagaacauccuguacaagaucugccucuccggcgacggguggccguacaucgccagccggaccuccaucgugggccgcgcgugggagaacaccaccgucgaccuggagagcgacggcaagccccagaaggugggggccgccggcuccaacaagagccugcaguccgccggguuccccaccggccucacguacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccaccgaccugaagcaguucaagcaggacgccaaguacagccacggcaucgacgugacggaccuguucuccgcccagccggggcucaccagcgccgugaucgaggcccugccccggaacaugguccugaccugccagggcagcgacgacaucaagcgccuccuggacucccaggggcgccgggacaucaagcugaucgacaucgcgcucagcaaggccgacucccgccgguucgagaacgccgugugggaccagugcaaggaccugugccacaugcacaccggcguggucguggagaagaagaagcgcgggggcaaggaggagaucacgccccacugcgcccugauggacugcaucauguacgacgccgcggugagcggcgggcucaacauccccguccugcgggccgugcugccgcgcgacaugguguuccggaccuccagccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6180 - RNA, 1892 nt, Artificial Sequence
  mRNA product Design3 comprising derived and/or modified sequence from Lassa virus__AIT17495__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcagagcgcccagccggggcgcgacggcguggugcgggucugggacgugaagaaccccgaccuccugaacaaccaguucgggaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuucaacuucagccugggcgccgccgugaaggccggggcgugcaugcucgacggcgggaacaugcuggagaccaucaaggucacgccccagaccauggacggcauccugaaguccauccucaaggugaagcggagccugggcauguucguguccgacgcccccggggagcgcaaccccuacgagaacauccuguacaagaucugccucagcggcgacggguggccguacaucgccucccggaccagcaucgucggccgcgccugggagaacaccacgguggaccuggaguccgacgggaagccccagaaggugggcaccgccggcagcaacaagucccugcagagcgcgggguuccccaccggccucaccuacucccagcugaugacgcugaaggacagcaugaugcagcuggaccccuccgccaagaccuggaucgacaucgaggggcggccggaggaccccgucgagaucgcccucuaccagcccaugagcggcugcuacauccacuucuuccgcgagcccaccgaccugaagcaguucaagcaggacgccaaguacucccacgggaucgacguggccgaccuguucccggcgcagcccggccucaccagcgccgucaucgaggcccugccccggaacauggugcugacgugccagggcagcgacgacaucaagaagcuccuggacucccaggggcgccgcgacaucaagcugaucgacaucgcccucagcaaggccgacucccggcgcuucgagaacgcggugugggaccagugcaaggaccugugccacaugcacaccggcgucgugguggagaagaagaagcgcgggggcaaggaggagaucacgccccacugcgcccugauggacugcaucauguacgacgccgccgucagcgggggccucaacaucccggugcugcgggcggugcugccccgggacauggucuuccgcaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6181 - RNA, 1892 nt, Artificial Sequence
  mRNA product Design3 comprising derived and/or modified sequence from Lassa virus__AIT17499__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaucaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcgccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacgugaagcgccuccuggacucccagggccgccgggacaucaagcugaucgacaucgcccucagcaaggccgacucccgccgguucgagaacgccgucugggaccagugcaaggaccugugccacaugcacaccggggugguggucgagaagaagaagcgcggcgggaaggaggagaucacgccccacugcgcgcugauggacugcaucauguacgacgccgccgugagcggcggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6182 - RNA, 1892 nt, Artificial Sequence
  mRNA product Design3 comprising derived and/or modified sequence from Lassa virus__AIT17503__NP (opt1)
gggagaaagcuuaccaugagcuccagcaaggaggugaaguccuuccuguggacccagagccuccgccgggagcuguccggcuacugcagcuccaucaagcugcaggucgugaaggacgcccaggcccuccugcacgggcuggacuucagcgagguguccaacguccagcgccucaugcggaagcagaagcgcgacgacagcgaccugaagcggcugcgcgaccucaaccaggcggugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugagccagucccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacgagcgccgucaucgaggcgcugccccgcaacauggugcugaccugccagggguccgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6183 - RNA, 1892 nt, Artificial Sequence
  mRNA product Design3 comprising derived and/or modified sequence from Lassa virus__AIT17507__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccaucgacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccgucgagaucgcgcuguaccagcccauguccgggugcuacauccacuucuuccgggagcccacggaccugaagcaguucaagcaggacgccaaguacagccacggcaucgacguggccgaccucuucccggcccagcccggccugaccuccgccgucaucgaggcgcugccccgcaacauggugcugaccugccaggggagcgacgacaucaagcggcuccuggacagccagggccgccgcgacaucaagcucaucgacaucgcccuguccaagguggacagccggcgcuucgagaacgccgucugggaccagugcaaggaccugugccacaugcacaccggggugguggucgagaagaagaagcggggcgggaaggaggagaucacgccccacugcgcccucauggacugcaucauguacgacgccgcgguguccggcggccugaacaucccggugcugcgcgccguccucccccgggacaugguguuccgcaccagcucccccaaggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6184 - RNA, 1892 nt, Artificial Sequence
  mRNA product Design3 comprising derived and/or modified sequence from Lassa virus__AIT17511__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccaucgacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaaggccgacagccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgccgcggucuccggcgggcucaacauccccgugcugcgggccgugcugccgcgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6185 - RNA, 1892 nt, Artificial Sequence
  mRNA product Design3 comprising derived and/or modified sequence from Lassa virus__AIT17515__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcgccgccgggagcuccaagagccugcaguccgccggcuuccccaccgggcucacguacagccagcugaugacccugaaggacuccaugaugcagcuggaccccagcgcgaagaccuggaucgacaucgagggccggccggaggaccccgucgagaucgcccucuaccagcccguguccgggugcuacauccacuucuuccgcgagcccaccgaccugaagcaguucaagcaggacgccaaguacagccacggcaucgacgucgccgaccuguucccggcccagcccggccucacgagcgcggugaucgaggcccugccccggaacauggugcugaccugccagggguccgacgacaucaagcgccuccuggacagccagggccgccgggacaucaagcugaucgacaucgcccucuccaaggccgacagccgccgguucgagaacgccgucugggaccagugcaaggaccugugccacaugcacaccggggugguggucgagaagaagaagcgcggcgggaaggaggagaucacgccccacugcgcgcugauggacugcaucauguacgacgccgccguguccggcggccucaacaucccggugcugcgggccguccugccccgcgacaugguguuccggaccagcucccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6186 - RNA, 1892 nt, Artificial Sequence
  mRNA product Design3 comprising derived and/or modified sequence from Lassa virus__AIT17519__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuucaacuucucccugggggccgccgugaaggccggcgcgugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgccagccggaccuccaucgucgggcgcgccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgcgaagaccuggaucgacaucgagggccggccggaggaccccgucgagaucgcccucuaccagcccauguccgggugcuacauccacuucuuccgcgagcccaccgaccugaagcaguucaagcaggacgccaaguacagccacggcaucgacguggccgaccuguucccggcccagcccggccucacguccgcggucaucgaggcccugccccggaacauggugcugaccugccaggggagcgacgacaucaagcgccuccuggacagccagggccgccgggacaucaagcugaucgacaucgcccucuccaaggccgacagccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucuccggcggccucaacaucccggugcugcgggccgugcugccccgcgacauggucuuccggaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6187 - RNA, 1892 nt, Artificial Sequence
  mRNA product Design3 comprising derived and/or modified sequence from Lassa virus__AIT17525__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacccugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccggcugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcgcagccuggggauguucgucuccgacacccccggcgagcggaaccccuacgagaacauccuguacaagaucugccucagcggggacggcuggccguacaucgcgucccgcaccagcaucguggggcgggccugggagaacaccaccguggaccuggaguccgacggcaagccccagaaggucggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccacggaccugaagcaguucaagcaggacgccaaguacucccacggcaucgacgucgccgaccuguucccgacccagcccggccucaccagcgccgugaucgaggcccugccccgcaacauggugcugaccugccaggggagcgacgacaucaagcgccuccuggacucccagggccggcgcgacaucaagcugaucgacaucgcgcucagcaaggccgacucccggaaguucgagaacgccgucugggaccagugcaaggaccugugccacaugcacacgggggugguggucgagaagaagaagcgcggcgggaaggaggagaucacgccccacugcgcccugauggacugcaucauguacgacgccgcggugagcggcggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6188 - RNA, 1892 nt, Artificial Sequence
  mRNA product Design3 comprising derived and/or modified sequence from Lassa virus__AIT17533__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgaggugaacaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcacccaggggacccagccgggccgcgacggggucgugcgggugugggacgucaagaaccccgaccuccugaacaaccaguucggcaccaugcccucccugacgcucgccugccugaccaagcagggccagguggaccugaacgacgccgugcucgcccugaccgaccuggggcucaucuacaccgcgaaguaccccaacagcuccgaccuggaccgccugagccagucccacccgauccucaacauggucgacacgaagaaguccagccugaacaucagcggcuacaacuucagccugggggccgccgugaaggccggcgccugcaugcucgacgggggcaacaugcuggagaccaucaaggugacgccccagaccauggacggcauccugaaguccauccucaaggucaagcggagccuggggauguucguguccgacacccccggcgagcgcaaccccuacgagaacauccuguacaagaucugccucagcggggacggcuggccguacaucgcgucccggaccagcaucguggggcgcgccugggagaacaccaccgucgaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccggccggaggaccccguggagaucgcgcucuaccagcccaugagcgggugcuacauccacuucuuccgcgagcccaccgaccugaagcaguucaagcaggacgccaaguacucccacggcaucgacgucgccgaccuguucccggcccagcccggccucaccagcgccgugaucgaggcgcugccccggaacaugguccugaccugccagggguccgacgacaucaagaagcuccuggacagccagggccgccgcgacaucaagcugaucgacaucagccucuccaagaucgacagccggaaguucgagaacgccgugugggaccagugcaaggaccugugccacaugcacacggggguggucguggagaagaagaagcgcggcgggaaggaggagaucacgccccacugcgcccugauggacugcaucauguucgacgccgccguguccggcggccucaacaucccgguccugcgggcggugcugccccgcgacaugguguuccggaccagcucccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6189 - RNA, 1892 nt, Artificial Sequence
  mRNA product Design3 comprising derived and/or modified sequence from Lassa virus__AIT17539__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacgcugaccagcgacgaccugcucauccuggccgccgaccuggagaagcucaaguccaaggugauccgcaccgagcggccccugagcuccggcgucuacauggggaaccugagcacccagcagcucgagcagcgcaaggcccugcuguccaugaucggcauggugggcggggcgcagggcacgcagccggggcgggacggcgugguccgcgugugggacgugaagaaccccgaccuccugaacaaccaguucgggaccaugcccagccugacccucgccugccugaccaagcagggccaggucgaccugaacgacgccgugcucgcccugacggaccugggccucaucuacaccgcgaaguaccccaacuccagcgaccuggaccggcugucccagagccacccgauccucaacaugguggacaccaagaaguccagccugaacaucagcggguacaacuucucccugggcgccgccgucaaggccggggccugcaugcucgacggcggcaacaugcuggagaccaucaaggugacgccccagaccauggacgggauccucaagagcauccugaaggugaagcgcucccugggcauguucgucagcgacacccccggggagcggaaccccuacgagaacauccuguacaagaucugccucuccggcgacggguggccguacaucgcgagccgcaccuccaucgugggccgggccugggagaacacgaccguggaccuggagagcgacggcaagccccagaaggucggguccgccggcagcaacaagucccugcagagcgccggguuccccaccggccucaccuacucccagcugaugacgcugaaggacagcaugaugcagcuggaccccuccgccaagaccuggaucgacaucgaggggcgcccggaggaccccguggagaucgcgcucuaccagcccaugagcggcugcuacauccacuucuuccgggagcccaccgaccugaagcaguucaagcaggacgccaaguacucccacggcaucgacgucaccgaccuguucagcgcccagccggggcucacgagcgccgugaucgaggcccugccccgcaacauggugcugaccugccagggcuccgacgacaucaagaagcuccuggacagccaggggcggcgcgacaucaagcugaucgacaucucccucggcaaggcggacagccgccgguucgagaacgccgucugggaccagugcaaggaccugugccacaugcacaccggggugguggucgagaagaagaagcgcggcggcaaggaggagaucacgccccacugcgcccugauggacugcaucauguucgacgccgccguguccgggggccucaacauccccauccugcgggcggugcugccgcgcgacauggucuuccggaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6190 - RNA, 1892 nt, Artificial Sequence
  mRNA product Design3 comprising derived and/or modified sequence from Lassa virus__AIT17541__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugagcuccgacgaccugcucacccuggccgccgaccuggagaagcucaagagcaaggugauccgcaccgagcggccccuguccagcggcgucuacauggggaaccuguccagccagcagcucgaccagcgccgggcccugcugaacaugaucggcaugaccuccgaccgccagggcgcgagcacggggcgggacggcaucgugcgcgugugggacgucaagaacgccgagcuccugaacaaccaguucgggaccgugccgucccugacccucgccugccugaccaagcagggccagguggaccugaacgacgccguccaggcgcucacggaccuggggcugaucuacaccgccaaguaccccaacagcagcgaccucgaccggcugucccagagccaccccauccugaacaugaucgacaccaagaaguccagccucaacaucuccggcuacaacuucagccugggcgccgccgugaaggccggggcgugcaugcuggacggcgggaacaugcucgagaccaucaaggugagcccccagacgauggacggcauccucaagagcauccugaaggucaagcgcucccugggcauguucgugagcgacaucccgggggagcggaaccccuacgagaacauccuguacaagaucugccuguccggcgacggguggcccuacaucgccagccgcaccuccaucaccggccgggccugggagaacaccaucguggaccucgagagcgacuccaagccccagaagccggggaacagcggcuccaaccgcagccugcaguccgccggcuuccccgccgggcugacguacagccagcucaugacccugaaggacagcaugcugcagcuggaccccaacgcgaagaccuggauggacaucgagggccggcccgacgacccggucgagaucgcccucuaccagcccuccagcgggugcuacauccacuucuuccgcgagcccaccgaccugaagcaguucaagcaggacgccaaguacucccacggcaucgacgugggggaccuguucgccgcccagcccggccucacgagcgcggugaucgaggcccugccgcgcaacauggucaucacgugccagggcuccgaggacaucaagaagcugcucgagagccaggggcggaaggacaucaagcugguggacaucuccaugagcaagcccgacucccgcaaguucgagaacgccgucugggaccaguacaaggaccugugccacaugcacaccggcaucgugguggagaagaagaagcgcgggggcaaggaggagaucacgccccacugcgcccucauggacugcaucauguucgacgccgcggucgucgggggccuggacgcccggauccugcgggccgugcucccccgcgacaugguguuccggaccagcaccccgaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6191 - RNA, 1892 nt, Artificial Sequence
  mRNA product Design3 comprising derived and/or modified sequence from Lassa virus__AIT17545__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccgggugggcacgcugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugucccagagccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgcgagccgcaccuccaucguggggcgggccugggagaacaccaccguggaccuggagagcgacggcaagccccagaaggucggcaucgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccguggagaucgcgcucuaccagcccauguccgggugcuacauccacuucuuccgggagcccaccgaccugaagcaguucaagcaggacgccaaguacagccacggcaucgacgucgccgaccuguucuccgcccagccgggccucacgagcgccgugaucgaggcgcugccccgcaacauggugcugaccugccaggggagcgacgacaucaagcggcuccuggacucccagggccgccgcgacaucaagcugaucgacaucgcccucagcaaggccgacucccggaaguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucgacauccccgugcugcgggccguccugccgcgcgacaugguguuccggaccuccagccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6192 - RNA, 1892 nt, Artificial Sequence
  mRNA product Design3 comprising derived and/or modified sequence from Lassa virus__AIT17549__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgucgugcucgcccugaccgaccuggggcucaucuacaccgccaaguaccccaacuccagcgaccuggaccgccugucccagagccacccgauccucaacaugguggacaccaagaaguccagccugaacaucagcggcuacaacuucucccugggggcggccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgccagccgcaccuccaucguggggcgggcgugggagaacaccaccguggaccuggagagcgacggcaagccccagaaggucggcaccgugggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcccucuaccagcccauguccgggugcuacauccacuucuuccgggagcccacggaccugaagcaguucaagcaggacgccaaguacagccacggcaucgacguggcggaccuguucccggcccagcccggccucaccuccgccgugaucgaggcccugccccgcaacaugguccugaccugccaggggagcgacgacaucaagaagcuccuggacagccagggccggcgcgacaucaagcugaucgacaucgcccucuccaaggcggacagccgcaaguucgagaacgccgugugggaccagugcaaggaccugugccacaugcacaccgggguggucguggagaagaagaagcggggcgggaaggaggagaucacgccccacugcgcccugauggacugcaucauguacgacgccgccguguccggcggccucaacaucccgguccugcgcgcggugcugccccgggacaugguguuccgcaccagcucccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6193 - RNA, 1892 nt, Artificial Sequence
  mRNA product Design3 comprising derived and/or modified sequence from Lassa virus__AIT17553__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccaugagcgggugcuacauccacuucuuccgcgagcccacggaccugaagcaguucaagcaggacgccaaguacucccacggcaucgacgucgccgaccuguucccggcccagcccggccucaccagcgccgugaucgaggcgcugccccggaacaugguccugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcccugauggacugcaucauguacgacgcggccgugagcggcggccucaacaucccgguccugcgcgccgugcugccccgggacaugguguuccgcaccuccagccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6194 - RNA, 1892 nt, Artificial Sequence
  mRNA product Design3 comprising derived and/or modified sequence from Lassa virus__AIT17561__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccaucgacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgucggguccaacaagagccugcaguccgccggcuuccccacggggcucaccuacagccagcugaugacccugaaggacuccaugaugcagcuggaccccagcgccaagaccuggaucgacaucgagggccgcccggaggaccccguggagaucgcccucuaccagcccauguccgggugcuacauccacuucuuccgggagcccacggaccugaagcaguucaagcaggacgcgaaguacagccacggcaucgacgucgccgaccuguucccggcccagcccggccucaccuccgccgugaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgucugggaccagugcaaggaccugugccacaugcacaccggggugguggucgagaagaagcggcgcggcgggaaggaggagaucacgccccacugcgcccugauggacugcaucauguacgacgccgcgguguccggcggccucaacaucccggugcugcgggccguccugccccgcgacaugguguuccggaccagcucccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6195 - RNA, 1892 nt, Artificial Sequence
  mRNA product Design3 comprising derived and/or modified sequence from Lassa virus__AIT17565__NP (opt1)
gggagaaagcuuaccaugagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaaggccgacucccgcaaguucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6196 - RNA, 1892 nt, Artificial Sequence
  mRNA product Design3 comprising derived and/or modified sequence from Lassa virus__AIT17569__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacguggccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaaccugccggugcugcgcgccgugcucccccgggacauggucuuccgcaccagcucccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6197 - RNA, 1892 nt, Artificial Sequence
  mRNA product Design3 comprising derived and/or modified sequence from Lassa virus__AIT17573__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacaucgccgaccuguucccggcccagcccggccucaccuccgccgugaucgaggcgcugccccgcaacaugguccugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgcggccguguccggcggccucaacaucccgguccugcgcgccgugcugccccgggacaugguguuccgcaccagcucccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6198 - RNA, 1892 nt, Artificial Sequence
  mRNA product Design3 comprising derived and/or modified sequence from Lassa virus__AIT17577__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgccgggcgcgccugggagaacaccaccgucgaccuggaguccgacggcaagccccagaaggugggcgccgccgggagcaacaagucccugcagagcgcgggcuuccccaccgggcucacguacucccagcugaugacccugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcgcagcccggccucacgagcgccgugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgcggugugggaccagugccgcgaccugugccacaugcacaccgggguggucguggagaagaagaagcggggcgggaaggaggagaucacgccccacugcgcccugauggacugcaucauguacgacgccgccgugagcggcggccucaacaucccgguccugcgcgcggugcugccccgggacaugguguuccgcaccuccagccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6199 - RNA, 1892 nt, Artificial Sequence
  mRNA product Design3 comprising derived and/or modified sequence from Lassa virus__AIT17581__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcgcccagcagcucgagcagcgccggacgcugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacguggugcucgcccugaccgaccugggccucaucuacaccgccaaguaccccaacagcuccgaccuggaccgccugagccagagccacccgauccucuccauggucgacaccaagaaguccagccugaacaucagcggcuacaacuucucccugggggcggccgugaaggccggcgccugcaugcucgacgggggcaacaugcuggagacgaucaaggugacgccccagaccauggacggcauccucaagagcauccugaaggucaagaagucccuggggauguucgugagcgacacccccggcgagcggaaccccuacgagaacauccuguacaagaucugccucuccggggacggcuggccguacaucgccagccgcaccuccaucguggggcgggcgugggagaacaccaccgucgaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcccucuaccagcccauguccgggugcuacauccacuucuuccgggagcccacggaccugaagcaguucaagcaggacgcgaaguacagccacggcaucgacgugaccgaccuguucccggcccagcccggccucaccagcgccgugaucgaggcccugccccgcaacaugguccugaccugccagggguccgacgacaucaagcggcuccuggacagccagggccgccgcgacaucaagcugaucgacaucgcccucuccaaggcggacagccggcgcuucgagaacgccgugugggaccagugcaaggaccugugccacaugcacacggggguggucguggagaagaagaagcggggcgggaaggaggagaucacgccccacugcgcccugauggacugcaucauguacgacgccgccguguccggcggccucaacaucccgguccugcgcgcggugcugccccgggacaugguguuccgcaccagcucccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6200 - RNA, 1892 nt, Artificial Sequence
  mRNA product Design3 comprising derived and/or modified sequence from Lassa virus__AIT17589__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuacaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccaccgggagcaacaagucccugcagagcgccggcuuccccacggggcucaccuacucccagcugaugacccugaaggacagcaugaugcagcuggaccccuccgccaagaccuggaucgacaucgagggccggccggaggaccccgucgagaucgcgcucuaccagcccaugagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagaagcuccuggacucccagggccgccgcgacaucaagcugaucgacaucgcccucagcaaggccgacucccggaaguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6201 - RNA, 1892 nt, Artificial Sequence
  mRNA product Design3 comprising derived and/or modified sequence from Lassa virus__AIT17593__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacggcgaccugaagcggcugcgcgaccucaaccaggccgugaacaaccugguggagcugaaguccacccagcagaaguccauccuccgggucgggacgcugaccagcgacgaccugcucacccuggccgccgaccuggagaagcucaagagcaaggugauccgcaccgagcggccccuguccagcggcguguacauggggaaccuguccagccagcagcucgagcagcgccgggcccugcugaacaugaucggcauggucggcggggcgcagggcacgcagccggggcgcgacggcguggugcgggucugggacgugaagaaccccgaccuccugaacaaccaguucgggaccaugcccucccugacccucgccugccugaccaagcagggccagguggaccugaacgacgccguccucgcccugacggaccugggccucaucuacaccgcgaaguaccccaacagcuccgaccuggaccgccugagccagagccacccgauccucaacaugguggacaccaagaaguccagccugaacaucuccggguacaacuucagccugggcgccgccgugaaggccggggccugcaugcucgacggcggcaacaugcuggagaccaucaaggucacgccccagaccauggacgggauccugaaguccauccucaaggugaagcggagccugggcauguucguguccgacacccccggggagcgcaaccccuacgagaacauccuguacaagaucugccucagcggcgacggguggccguacaucgcgucccggaccagcaucgucggccgcgccugggagaacacgaccguggaccuggaguccgacggcaagccccagaaggugggggccgccggcagcaccaagucccugcagagcgccggguuccccaccggccucacguacucccagcugaugacccugaaggacagcaugaugcagcuggaccccuccgcgaagaccuggaucgacaucgaggggcggccggaggaccccgucgagaucgcccucuaccagcccaugagcggcugcuacauccacuucuuccgcgagcccaccgaccugaagcaguucaagcaggacgccaaguacucccacggcaucgacguggccgaccuguucccggcccagcccgggcucacgagcgcggucaucgaggcccugccccggaacauggugcugaccugccagggcagcgacgacaucaagcgccuccuggacucccaggggcgccgggacaucaagcugaucgacaucgcccucagcaagguggacucccgccgguucgagaacgccgucugggaccagugcaaggaccugugccacaugcacaccggcgugguggucgagaagaagaagcgcgggggcaaggaggagaucacgccccacugcgcccugauggacugcaucauguacgacgcggccgugagcggcgggcucaacaucccggugcugcgggccguccugccccgcgacaugguguuccggaccuccagccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6202 - RNA, 1892 nt, Artificial Sequence
  mRNA product Design3 comprising derived and/or modified sequence from Lassa virus__AIT17605__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagagccacccgauccucaacauggucgacaccaagaaguccagccugaacaucuccggcuacaacuucagccugggggccgccgugaaggccggcgcgugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggccugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgcgaagaccuggaucgacaucgagggccgcccggaggaccccguggagaucgcccucuaccagcccaugagcgggugcuacauccacuucuuccgggagcccacggaccugaagcaguucaagcaggacgccaaguacucccacggcaucgacgucgccgaccuguucagcgcccagccgggccucaccagcgcggugaucgaggcccugccccgcaacaugguccugaccugccagggguccgacgacaucaagcggcuccuggacagccagggccgccgcgacaucaagcugaucgacaucgcccucuccaaggccgacagccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccguguccggcggccucaacauccccguccugcgcgccgugcugccgcgggacaugguguuccgcaccagcucccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6203 - RNA, 1892 nt, Artificial Sequence
  mRNA product Design3 comprising derived and/or modified sequence from Lassa virus__AIT17609__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagagccacccgauccucaacauggucgacaccaagaaguccagccugaacaucuccggcuacaacuucagccugggggccgccgugaaggccggcgcgugcaugcucgacgggggcaacaugcuggagacgaucaaggugacgccccagaccauggacggcauccugaaguccauccucaaggucaagcggagccuggggauguucguguccgacacccccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcgccgccgggagcaacaagucccugcagagcgcgggcuuccccaccgggcucacguacucccagcugaugacccugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcgcagcccggccucacgagcgccgugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgcggugugggaccagugcaaggaccugugccacaugcacaccgggguggucguggagaagaagaagcgcggcgggaaggaggagaucacgccccacugcgcccugauggacugcaucauguacgacgccgccgugagcggcggccucaacaucccgguccugcgggcggugcugccccgcgacaugguguuccggaccuccagccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6204 - RNA, 1892 nt, Artificial Sequence
  mRNA product Design3 comprising derived and/or modified sequence from Lassa virus__AIT17613__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccgucgagaucgcgcucuaccagcccauguccgggugcuacauccacuucuuccgcgagcccacggaccugaagcaguucaagcaggacgccaaguacagccacggcaucgacguggccgaccuguucccggcccagcccggccucaccuccgccgucaucgaggcgcugccccggaacauggugcugaccugccaggggagcgacgacaucaagcgccuccuggacagccagggccgccgggacaucaagcugaucgacaucgcccucuccaagaccgacagccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucuccggcggccucaacaucccggugcugcgggccgugcugccccgcgacauggucuuccggaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6205 - RNA, 1892 nt, Artificial Sequence
  mRNA product Design3 comprising derived and/or modified sequence from Lassa virus__AIT17617__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuucaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6206 - RNA, 1892 nt, Artificial Sequence
  mRNA product Design3 comprising derived and/or modified sequence from Lassa virus__AIT17621__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugaccaacguccagcgccucaugcggaagcagaagcgcgacgacagcgaccugaagcggcugcgcgaccucaaccaggccgugaacaaccugguggagcugaaguccacgcagcagaaguccauccuccgggucggcacccugaccagcgacgaccugcucacccuggccgccgaccuggagaagcucaagagcaaggugauccgcacggagcggccccuguccagcgggguguacaugggcaaccuguccacccagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacgcucgccugccugaccaagcagggccagguggaccugaacgacgccguccucgcccugaccgaccuggggcucaucuacaccgcgaaguaccccaacuccagcgaccuggaccgccugucccagagccacccgauccucaacaugguggacacgaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaucgccggguccaacaagagccugcaguccgccggcuuccccacggggcucaccuacagccagcugaugacccugaaggacuccaugaugcagcuggaccccagcgccaagaccuggaucgacaucgagggccggccggaggaccccgucgagaucgcgcucuaccagcccauguccgggugcuacauccacuucuuccgcgagcccacggaccugaagcaguucaagcaggacgccaaguacagccacggcaucgacguggccgaccuguucccggcccagcccggccucaccuccgccgucaucgaggcgcugccccggaacauggugcugaccugccaggggagcgacgacaucaagcgccuccuggacagccagggccgccgggacaucaagcugaucgacaucgcccucuccaaggccgacagccgcaaguucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6207 - RNA, 1892 nt, Artificial Sequence
  mRNA product Design3 comprising derived and/or modified sequence from Lassa virus__AIT17625__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacgcugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccggcugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcgcagccuggggauguucgucuccgacacccccggcgagcggaaccccuacgagaacauccuguacaagaucugccucagcggggacggcuggccguacaucgcgucccgcaccagcaucguggggcgggccugggagaacaccaccguggaccuggaguccgacggcaagccccagaaggucggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccacggaccugaagcaguucaagcaggacgccaaguacucccacggcaucgacgucgccgaccuguucccggcccagcccggccucaccagcgccgugaucgaggcgcugccccgcaacauggugcugaccugccaggggagcgacgacaucaagcgccuccuggacucccagggccggcgcgacaucaagcugaucgacaucgcccucagcaaggccgacucccggaaguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6208 - RNA, 1892 nt, Artificial Sequence
  mRNA product Design3 comprising derived and/or modified sequence from Lassa virus__AIT17627__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcucccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugagccagucccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacacgaccguggaccuggagagcgacggcaagccccagaaggugggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccgucgagaucgcgcucuaccagcccaugagcgggugcuacauccacuucuuccgcgagcccaccgaccugaagcaguucaagcaggacgccaaguacagccacggcaucgacguggccgaccuguucccggcccagcccggccucaccuccgccgucaucgaggcgcugccccggaacauggugcugacgugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6209 - RNA, 1892 nt, Artificial Sequence
  mRNA product Design3 comprising derived and/or modified sequence from Lassa virus__AIT17631__NP (opt1)
gggagaaagcuuaccaugagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccgggguggucguggagaagaagaagcgcggcgggaaggaggagaucacgccccacugcgcgcugauggacugcaucauguacgacgccgccgugagcggcggccucaacaucccgguccugcgggccgugcugccccgcgacaugguguuccggaccuccagccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6210 - RNA, 1892 nt, Artificial Sequence
  mRNA product Design3 comprising derived and/or modified sequence from Lassa virus__AIT17635__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacaacgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugaacacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacucccagggccgccgcgacaucaagcugaucgacaucgcccucagcaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6211 - RNA, 1892 nt, Artificial Sequence
  mRNA product Design3 comprising derived and/or modified sequence from Lassa virus__AIT17639__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaucaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacacgaccguggaccuggagagcgacggcaagccccagaaggugggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccgucgagaucgcgcucuaccagcccaugagcgggugcuacauccacuucuuccgcgagcccaccgaccugaagcaguucaagcaggacgccaaguacucccacggcaucgacguggccgaccuguucccggcccagcccggccucaccagcgccgucaucgaggcgcugccccggaacauggugcugacgugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6212 - RNA, 1892 nt, Artificial Sequence
  mRNA product Design3 comprising derived and/or modified sequence from Lassa virus__AIT17643__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuacaacuucucccugggggccgccgugaaggccggcgcgugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgccagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgcgaagaccuggaucgacaucgagggccgcccggaggaccccgucgagaucgcccucuaccagcccauguccgggugcuacauccacuucuuccgggagcccaccgaccugaagcaguucaagcaggacgccaaguacagccacggcaucgacguggccgaccuguucccggcccagcccggccucacguccgcggucaucgaggcccugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcgcugauggacugcaucauguacgacgccgccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6213 - RNA, 1892 nt, Artificial Sequence
  mRNA product Design3 comprising derived and/or modified sequence from Lassa virus__AIT17651__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcgcccagcagcucgagcagcgccgggcgcugcugaacaugaucgggauggugggcggcgcccaggggacgcagccgggccgcgacggggugguccgggugugggacgugaagaaccccgaccuccugaacaaccaguucggcaccaugcccucccugacccucgccugccugaccaagcaggggcaggucgaccugaacgacguggugcucgcccugacggaccugggccucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagaccaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgcgucccgcaccagcaucguggggcgggccugggagaacacgaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccgucgagaucgcgcucuaccagcccaugagcgggugcuacauccacuucuuccgggagcccaccgaccugaagcaguucaagcaggacgccaaguacucccacggcaucgacgugacggaccuguucagcgcccagccgggccucaccagcgccgugaucgaggcccugccccgcaacaugguccugaccugccagggguccgacgacaucaagcggcuccuggacagccagggccgccgcgacaucaagcugaucgacaucgcgcucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgccgcgguguccggcggccucaacauccccguccugcgcgccgugcugccgcgggacaugguguuccgcaccagcucccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6214 - RNA, 1892 nt, Artificial Sequence
  mRNA product Design3 comprising derived and/or modified sequence from Lassa virus__AIT17655__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagaagccccuguccagcgggguguacaugggcaaccuguccacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccggcugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccggccggaggaccccgucgagaucgcccucuaccagcccauguccgggugcuacauccacuucuuccgcgagcccaccgaccugaagcaguucaagcaggacgcgaaguacagccacggcaucgacguggccgaccuguucccggcccagcccggccucaccuccgccgucaucgaggcccugccccggaacauggugcugaccugccaggggagcgacgacaucaagcgccuccuggacagccagggccggcgcgacaucaagcugaucgacaucgcgcucuccaaggccgacagccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucuccggcggccucaacaucccggugcugcgggccgugcugccccgcgacauggucuuccggaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6215 - RNA, 1892 nt, Artificial Sequence
  mRNA product Design3 comprising derived and/or modified sequence from Lassa virus__AIT17659__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcuguccaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccagcgccgugaucgaggcgcugccccggaacauggugcugaccugccagggguccgacgacaucaagcgccuccuggacagccagggccgccgggacaucaagcugaucgacaucgcccucaacaaggccgacucccgccgguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6216 - RNA, 1892 nt, Artificial Sequence
  mRNA product Design3 comprising derived and/or modified sequence from Lassa virus__AIT17663__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccgucgagaucgcgcucuaccagcccaugagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6217 - RNA, 1892 nt, Artificial Sequence
  mRNA product Design3 comprising derived and/or modified sequence from Lassa virus__AIT17667__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccaucgacggcauccugaaguccauccucaaggugaagaagucccuggggauguucgugagcgacacccccggcgagcggaaccccuacgagaacauccuguacaagaucugccucagcggggacggcuggccguacaucgcgucccgcaccagcaucgucgggcgggccugggagaacaccaccguggaccuggaguccgacggcaagccccagaaggugggcaccacggggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacgugaccgaccuguucccggcccagcccggccucaccagcgccgucaucgaggcccugccccgcaacauggugcugacgugccaggggagcgaggacaucaagcggcuccuggacucccagggccgccgcgacaucaagcugaucgacaucgcccucagcaaggcggacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgccgccgucagcggcggccucaacaucccggugcugcgcgcggugcugccccgggacauggucuuccgcaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6218 - RNA, 1892 nt, Artificial Sequence
  mRNA product Design3 comprising derived and/or modified sequence from Lassa virus__AIT17671__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacguggugcucgcccugaccgaccugggccucaucuacaccgccaaguaccccaacagcuccgaccuggaccgccugagccagagccacccgauccucaacauggucgacaccaagaaguccagccugaacaucuccggcuacaacuucagccugggggcggccgugaaggccggcgccugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggcgugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccgucgagaucgcccucuaccagcccaugagcgggugcuacauccacuucuuccgggagcccacggaccugaagcaguucaagcaggacgcgaaguacucccacggcaucgacgugaccgaccuguucccggcccagcccggccucaccagcgccgugaucgaggcccugccccgcaacaugguccugaccugccaggggagcgacgacaucaagcggcuccuggacucccagggccgccgcgacaucaagcugaucgacaucgcccucagcaaggcggacucccggcgcuucgagaacgccgugugggaccagugcaaggaccugugccacaugcacacggggguggucguggagaagaagaagcggggcgggaaggaggagaucacgccccacugcgcccugauggacugcaucauguacgacgccgccgugagcggcggccucaacaucccgguccugcgcgcggugcugccccgggacaugguguuccgcaccuccagccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6219 - RNA, 1892 nt, Artificial Sequence
  mRNA product Design3 comprising derived and/or modified sequence from Lassa virus__AIT17675__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacgccgugcucgcccugaccgaccugggccucaucuacaccgcgaaguaccccaacagcuccgaccuggaccgccugagccagagccacccgauccucaacaugguggacaccaagaaguccagccugaacaucuccggcuacaacuucagccugggggccgccgucaaggccggcgccugcaugcucgacgggggcaacaugcuggagacgaucaaggugacgccccagaccauggacggcauccugaaguccauccucaaggugaagaagucccuggggauguucgucagcgacacccccggcgagcggaaccccuacgagaacauccuguacaagaucugccucagcggggacggcuggccguacaucgcgucccgcaccagcaucguggggcgggccugggagaacaccaucguggaccuggaguccgacggcaagccccagaaggucggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccaccgaccugaagcaguucaagcaggacgccaaguacucccacggcaucgacgucgccgaccuguucccggcccagcccggccucacgagcgccgugaucgaggcgcugccccgcaacauggugcugaccugccaggggagcgacgacaucaagcggcuccuggacucccagggccgccgcgacaucaagcugaucgacaucgcccucagcaaggccgacucccggcgcuucgagaacgccgucugggaccagugcaaggaccugugccacaugcacaccggggugguggucgagaagaagaagcggggcgggaaggaggagaucacgccccacugcgcccugauggacugcaucauguacgacgcggccgugagcggcggccucaacaucccggugcugcgcgccguccugccccgggacaugguguuccgcaccuccagccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6220 - RNA, 1892 nt, Artificial Sequence
  mRNA product Design3 comprising derived and/or modified sequence from Lassa virus__AIT17679__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaguccacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaacaugguggacaccaagaaguccagccugaacaucagcggcuacaacuucucccugggcgccgccgugaaggccggggccugcaugcucgacggcgggaacaugcuggagacgaucaaggucacgccccagaccauggacggcauccucaagagcauccugaaggugaagcggucccugggcauguucgugagcgacacccccggggagcgcaaccccuacgagaacauccuguacaagaucugccucuccggcgacggguggccguacaucgcgagccggaccuccaucgucggccgcgccugggagaacaccaccguggaccuggagagcgacgggaagccccagaaggugggcaccgccggcuccaacaagagccugcaguccgccggguuccccacgggccucaccuacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccacggaccugaagcaguucaagcaggacgccaaguacagccacgggaucgacguggccgaccuguucccggcccagcccggccucaccagcgccgucaucgaggcgcugccccggaacauggugcugaccugccagggcuccgacgacaucaagcgccuccuggacagccaggggcgccgggacaucaagcugaucgacaucgcccucuccaaggccgacagccgccgguucgagaacgccgugugggaccagugcaaggaccugugccacaugcacaccggcgucgugguggagaagaagaagcgcgggggcaaggaggagaucacgccccacugcgcccugauggacugcaucauguacgacgcggccgucuccgggggccucaacaucccggugcugcgggccgugcugccccgcgacauggucuuccggaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6221 - RNA, 1892 nt, Artificial Sequence
  mRNA product Design3 comprising derived and/or modified sequence from Lassa virus__AIT17683__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuucaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6222 - RNA, 1892 nt, Artificial Sequence
  mRNA product Design3 comprising derived and/or modified sequence from Lassa virus__AIT17687__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuacaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6223 - RNA, 1892 nt, Artificial Sequence
  mRNA product Design3 comprising derived and/or modified sequence from Lassa virus__AIT17695__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgucgugcuggcccugaccgaccucgggcugaucuacaccgccaaguaccccaacuccagcgaccuggaccgccucucccagagccacccgauccugaacaugguggacaccaagaaguccagccugaacaucagcggcuucaacuucucccucggggcggccgucaaggccggcgccugcaugcuggacgggggcaacaugcuggagacgaucaaggugacgccccacaccauggacggcauccucaagagcauccugaaggugaagaagucccuggggauguucgucagcgacacccccggcgagcggaaccccuacgagaacauccucuacaagaucugccuguccggggacggcuggccguacaucgccagccgcaccuccaucguggggcgggcgugggagaacaccaccguggaccuggagagcgacggcaagccccacaaggucggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccguggagaucgcccuguaccagcccauguccgggugcuacauccacuucuuccgggagcccacggaccugaagcaguucaagcaggacgcgaaguacagccacggcaucgacgucgccgaccucuucccggcccagcccggccugaccuccgccgugaucgaggcccugccccgcaacauggugcugaccugccaggggagcgacgacaucaagcggcuccuggacagccagggccgccgcgacaucaagcucaucgacaucgcgcuguccaaggccgacagccggcgcuucgagaacgccgucugggaccagugcaaggaccugugccacaugcacaccggggugguggucgagaagaagaagcggggcgggaaggaggagaucacgccccacugcgcccucauggacugcaucauguacgacgccgcgguguccggcggccugaacaucccggugcugcgcgccguccucccccgggacaugguguuccgcaccagcucccccaaggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6224 - RNA, 1892 nt, Artificial Sequence
  mRNA product Design3 comprising derived and/or modified sequence from Lassa virus__AIT17705__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaaccgcagccuccaguccgccggcuuccccacggggcugaccuacagccagcugaugacccugaaggacuccaugaugcagcucgaccccagcgccaagaccuggaucgacaucgagggccggccggaggaccccgucgagaucgcgcuguaccagcccauguccgggugcuacauccacuucuuccgcgagcccacggaccugaagcaguucaagcaggacgccaaguacagccacggcaucgacguggccgaccucuucccggcccagcccggccugaccuccgccgucaucgaggcgcugccccggaacauggugcugaccugccaggggagcgacgacaucaagcgccuccuggacagccagggccgccgggacaucaagcucaucgacaucgcccuguccaaggccgacagccgccgguucgagaacgccgugugggaccagugcaaggaccugugccacaugcacaccggggucgugguggagaagaagaagcgcggcgggaaggaggagaucacgccccacugcgcccucauggacugcaucauguacgacgcggccgucuccggcggccugaacaucccggugcugcgggccgugcucccccgcgacauggucuuccggaccagcucccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6225 - RNA, 1892 nt, Artificial Sequence
  mRNA product Design3 comprising derived and/or modified sequence from Lassa virus__AIT17711__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccagcaagucccuccagagcgccggcuuccccacggggcugaccuacucccagcugaugacccugaaggacagcaugaugcagcucgaccccuccgccaagaccuggaucgacaucgagggccgcccggaggaccccgucgagaucgcgcuguaccagcccaugagcgggugcuacauccacuucuuccgggagcccacggaccugaagcaguucaagcaggacgccaaguacucccacggcaucgacguggccgaccucuucccggcccagcccggccugaccagcgccgucaucgaggcgcugccccgcaacauggugcugaccugccaggggagcgacgacaucaagcggcuccuggacucccagggccgccgcgacaucaagcucaucgacaucgcccugagcaaggccgacucccggcgcuucgagaacgccgugugggaccagugcaaggaccugugccacaugcacaccggggucgugguggagaagaagaagcggggcgggaaggaggagaucacgccccacugcgcccucauggacugcaucauguacgacgcggccgucagcggcggccugaacaucccggugcugcgcgccgugcucccccgggacauggucuuccgcaccuccagccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6226 - RNA, 1892 nt, Artificial Sequence
  mRNA product Design3 comprising derived and/or modified sequence from Lassa virus__AIT17713__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaucaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacguccgccgucaucgaggcgcugccccgcaacauggugcugaccugccaggggagcgacgacaucaagcggcuccuggacagccagggccgccgcgacaucaagcugaucgacaucgcccucaacaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6227 - RNA, 1892 nt, Artificial Sequence
  mRNA product Design3 comprising derived and/or modified sequence from Lassa virus__AIT17719__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucuccggcgcgcagggcacccagccggggcgcgacggcguggugcgggucugggacgugaagaaccccgagcuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaacaugguggacaccaagaaguccagccugaacaucagcggcuacaacuucucccugggcgccgccgugaaggccggggccugcaugcucgacggcgggaacaugcuggagacgaucaaggucacgccccagaccauggacggcauccucaagagcauccugaaggugaagaagucccugggcauguucgugagcgacacccccggggagcggaaccccuacgagaacauccuguacaagaucugccucuccggcgacggguggccguacaucgcgagccgcaccuccaucgucggccgggccugggagaacaccaccguggaccuggagagcgacgggaagccccagaaggugggcaccgccggcuccaacaagagccugcaguccgccggguuccccacgggccucaccuacagccagcugaugacccugaaggacuccaugaugcagcuggaccccagcgccaagaccuggaucgacaucgaggggcgcccggaggaccccgucgagaucgcgcucuaccagcccauguccggcugcuacauccacuucuuccgggagcccacggaccugaagcaguucaagcaggacgccaaguacagccacgggaucgacguggccgaccuguucccggcccagcccggccucaccagcgccgucaucgaggcgcugccccgcaacauggugcugaccugccagggcuccgacgacaucaagcggcuccuggacagccaggggcgccgcgacaucaagcugaucgacaucucccucagcaaggccgacucccggcgcuucgagaacgccgugugggaccagugcaaggaccugugccacaugcacaccggcgucgugguggagaagaagaagcgcgggggcaaggaggagaucacgccccacugcgcccugauggacugcaucauguacgacgccgcggucagcgggggccucaacaucccggugcugcgggccgugcugccccgggacauggucuuccgcaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6228 - RNA, 1892 nt, Artificial Sequence
  mRNA product Design3 comprising derived and/or modified sequence from Lassa virus__AIT17725__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagcucggccgcgacgggguggugcgggucugggacgugaagaacccggaccugcugaacaaccaguucggcaccaugcccagccucacccuggccugccugaccaagcagggccagguggaccucaacgacgccguccuggcgcugacggaccucgggcugaucuacaccgccaaguaccccaacuccagcgaccuggaccgccucucccagagccaccccauccugaacaugguggacaccaagaaguccagccugaacaucagcggcuacaacuucucccucggggccgccgugaaggccggcgcgugcaugcuggacgggggcaacaugcuggagaccaucaaggucacgccgcagaccauggacggcauccucaagagcauccugaaggugaagaagucccuggggauguucgugagcgacacccccggcgagcggaaccccuacgagaacauccucuacaagaucugccuguccggggacggcuggcccuacaucgccagccgcaccuccaucgucgggcgggccugggagaacacgaccguggaccuggagagcgacggcaagccgcagaaggugggcaccgccggguccaacaagagccuccaguccgccggcuuccccaccgggcugacguacagccagcugaugacccugaaggacuccaugaugcagcucgaccccagcgcgaagaccuggaucgacaucgagggccgccccgaggacccggucgagaucgcccuguaccagcccauguccgggugcuacauccacuucuuccgggagcccaccgaccugaagcaguucaagcaggacgccaaguacagccacggcaucgacguggccgaccucuuccccgcccagccgggccugacguccgcggucaucgaggcccugccccgcaacauggugcugaccugccaggggagcgaggacaucaagcggcuccuggacagccagggccgccgcgacaucaagcucaucgacaucgcccuguccaaggccgacagccggcgcuucgagaacgccgugugggaccagugcaaggaccugugccacaugcacaccggggucgugguggagaagaagaagcggggcgggaaggaggagaucacgccccacugcgcgcucauggacugcaucauguacgacgccgccgucuccggcggccugaacauccccgugcugcgcgccgugcucccgcgggacauggucuuccgcaccagcucccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6229 - RNA, 1892 nt, Artificial Sequence
  mRNA product Design3 comprising derived and/or modified sequence from Lassa virus__AIT17729__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacccugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcacccaggggacccagccgggccgggacgggguggugcgcgucugggacgugaagaaccccgaccuccugaacaaccaguucggcaccaugcccucccugacgcucgcgugccugaccaagcagggccagguggaccugaacgacgccguccucgcccugaccgaccuggggcucaucuacaccgccaaguaccccaacagcuccgaccuggaccggcugagccagagccacccgauccucaacaugguggacacgaagaaguccagccugaacaucuccggcuacaacuucagccugggggcggccgugaaggccggcgccugcaugcucgacgggggcaacaugcuggagaccaucaaggucacgccccagaccauggacggcauccugaaguccauccucaaggugaagcgcagccuggggauguucguguccgacacccccggcgagcggaaccccuacgagaacauccuguacaagaucugccucagcggggacggcuggccguacaucgccucccgcaccagcaucgucgggcgggcgugggagaacaccaccguggaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacguggccgaccuguucccggcccagcccggccucaccagcgccgucaucgaggcccugccccgcaacauggugcugaccugccaggggagcgacgacaucaagcgccuccuggacucccagggccggcgcgacaucaagcugaucgacaucgcgcucagcaaggccgacucccggaaguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6230 - RNA, 1892 nt, Artificial Sequence
  mRNA product Design3 comprising derived and/or modified sequence from Lassa virus__AIT17733__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucauccuggccgccgaccuggagaagcucaagagcaaggugauccgcaccgagcggccccuguccagcgggguguacaugggcaaccuguccacccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacguccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6231 - RNA, 1892 nt, Artificial Sequence
  mRNA product Design3 comprising derived and/or modified sequence from Lassa virus__AIT17745__NP (opt1)
gggagaaagcuuaccaugagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaagguggacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6232 - RNA, 1892 nt, Artificial Sequence
  mRNA product Design3 comprising derived and/or modified sequence from Lassa virus__AIT17753__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcaccacggggagcaacaagucccugcagagcgccggcuuccccaccgggcucaccuacucccagcugaugacccugaaggacagcaugaugcagcuggaccccuccgccaagacguggaucgacaucgagggccggccggaggaccccgucgagaucgcccucuaccagcccaugagcgggugcuacauccacuucuuccgcgagcccaccgaccugaagcaguucaagcaggacgcgaaguacucccacggcaucgacguggccgaccuguucccggcccagcccggccucaccagcgccgucaucgaggcccugccccggaacauggugcugaccugccaggggagcgacgacaucaagcgccuccuggacucccagggccgccgggacaucaagcugaucgacaucgcgcucagcaaggccgacucccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucagcggcggccucaacaucccggugcugcgggccgugcugccccgcgacauggucuuccggaccuccagccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6233 - RNA, 1892 nt, Artificial Sequence
  mRNA product Design3 comprising derived and/or modified sequence from Lassa virus__AIT17763__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcggagccuggggauguucgucuccgacacccccggcgagcgcaaccccuacgagaacauccuguacaagaucugccucagcggggacggcuggccguacaucgcgucccggaccagcaucguggggcgcgccugggagaacaccaccguggaccuggaguccgacgagaagccccagaaggucggcgccgccggcagcaacaagucccugcagagcgccggguuccccaccggccucacguacucccagcugaugacccugaaggacagcaugaugcagcuggaccccuccgcgaagaccuggaucgacaucgaggggcggccggaggaccccguggagaucgcccucuaccagcccaugagcggcugcuacauccacuucuuccgcgagcccaccgaccugaagcaguucaagcaggacgccaaguacucccacgggaucgacgucacggaccuguucccggcccagcccggccucaccagcgccgugaucgaggcgcugccccggaacauggugcugaccugccagggcagcgacgacaucaagcgccuccuggacucccaggggcgccgggacaucaagcugaucgacaucgcccucagcaaggccgacucccgccgguucgagaacgccgucugggaccagugcaaggaccugugccacaugcacaccggcgugguggucgagaagaagaagcgcgggggcaaggaggagaucacgccccacugcgcccugauggacugcaucauguacgacgcggccgugagcgggggccucaacaucccggugcugcgggccguccugccccgcgacaugguguuccggaccuccagccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6234 - RNA, 1892 nt, Artificial Sequence
  mRNA product Design3 comprising derived and/or modified sequence from Lassa virus__AIT17771__NP (opt1)
gggagaaagcuuaccaugagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagacccagaaggugagcacggccggcuccaacaagagccugcaguccgccggguuccccaccggccucaccuacagccagcugaugacccugaaggacuccaugaugcagcuggaccccagcgccaagacguggaucgacaucgaggggcggcccgaggacccggucgagaucgcgcucuaccagcccauguccggcugcuacauccacuucuuccgcgagcccaccgaccugaagcaguucaagcaggacgccaaguacagccacgggaucgacgugaccgaccuguuccccgcccagccgggccucaccagcgccgucaucgaggcccugccccggaacauggugcugacgugccagggcuccgacgacaucaagcgccuccuggacagccaggggcgccgggacaucaagcugaucgacaucgcgcucuccaaggccgacagccgccgguucgagaacgccgugugggaccagugcaaggaccugugccacaugcacaccggcgucgugguggagaagaagaagcgcgggggcaaggaggagaucacgccccacugcgcccugauggacugcaucauguacgacgccgcggucuccgggggccucaacauccccgugcugcgggccgugcugccgcgcgacauggucuuccggaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6235 - RNA, 1892 nt, Artificial Sequence
  mRNA product Design3 comprising derived and/or modified sequence from Lassa virus__AIT17779__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaagacggacagccggcgcuucgagaacgccgugugggaccagugcaaggaccugugccacaugcacaccggcgucgugguggagaagaagaagcgcgggggcaaggaggagaucacgccccacugcgcccugauggacugcaucauguacgacgccgccgucuccggcgggcucaacauccccgugcugcgggcggugcugccgcgggacauggucuuccgcaccagcucccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6236 - RNA, 1892 nt, Artificial Sequence
  mRNA product Design3 comprising derived and/or modified sequence from Lassa virus__AIT17783__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgucgugcucgcccugaccgaccuggggcucaucuacaccgccaaguaccccaacuccagcgaccuggaccgccugucccagagccacccgauccucaacaugguggacaccaagaaguccagccugaacaucagcggcuacaacuucucccugggggcggccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgccagccgcaccuccaucguggggcgggcgugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccguggagaucgcccucuaccagcccgucuccgggugcuacauccacuucuuccgggagcccacggaccugaagcaguucaagcaggacgcgaaguacagccacggcaucgacguggccgaccuguucccggcccagcccggccucaccuccgccgugaucgaggcccugccccgcaacaugguccugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgccgcgguguccggcggccucaacaucccgguccugcgcgccgugcugccccgggacaugguguuccgcaccagcucccccaaggucgugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6237 - RNA, 1892 nt, Artificial Sequence
  mRNA product Design3 comprising derived and/or modified sequence from Lassa virus__AIT17787__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaagguggacagccggcgcuucgagaacgccgucugggaccagugcaaggaccugugccacaugcacacgggcgugguggucgagaagaagaagcgcgggggcaaggaggagaucacgccccacugcgcccugauggacugcaucauguacgacgccgccguguccggcgggcucaacauccccgugcugcgggcgguccugccgcgggacaugguguuccgcaccagcucccccaaggugguccucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6238 - RNA, 1892 nt, Artificial Sequence
  mRNA product Design3 comprising derived and/or modified sequence from Lassa virus__AIT17803__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcucccaggaggcccgggccgggcgcgacggcgugguccgggugugggacgugaagaacgccgagcuccugaacaaccaguucgggaccaugccgagccugacgcucgcgugccugaccaagcagggccaggucgaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggcgccgcggugaaggccggggccugcaugcuggacggcgggaacaugcucgagaccaucaaggucagcccccagacgguggacggcauccugaaguccauccugaaggugaagaaggcccucggcauguucaucagcgacaccccgggggagcggaaccccuacgagaacauccuguacaagaucugccuguccggcgacggguggcccuacaucgccagccgcaccuccaucaccggccgggcgugggagaacacggucguggaccucgagagcgacgggaagccccagaaggccggcuccaacaacagcaacaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgucaccgaccuguucgccgcccagcccgggcucaccuccgcggugaucgacgcccugccccgcaacauggugaucacgugccagggcagcgacgacauccgcaagcugcucgagagccagggccggaaggacaucaagcugaucgacaucgcccuguccaagaccgacagccgcaaguacgagaacgccgucugggaccaguacaaggaccucugccacaugcacaccgggguggucguggagaagaagaagaagggcgggaaggaggagaucacgccccacugcgcgcugauggacugcaucauguucgacgccgccguguccggcgggcugaacaccagcguccuccgggccgugcugccgcgcgacaugguguuccggaccuccacgccccgcgucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6239 - RNA, 1892 nt, Artificial Sequence
  mRNA product Design3 comprising derived and/or modified sequence from Lassa virus__AIT17811__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgccuucuaccagcccuccagcggcugcuacauccacuucuuccgggagccgaccgaccucaagcaguucaagcaggacgccaaguacucccacgggaucgacgugaccgaccuguucgccgcccagcccggccugacgagcgcggucaucgacgcccucccccgcaaccuggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacgccuccgugcugcgggccgugcucccccgggacauggucuuccgcaccagcacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6240 - RNA, 1892 nt, Artificial Sequence
  mRNA product Design3 comprising derived and/or modified sequence from Lassa virus__AIT17815__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuggacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgggacauggucuuccgcaccagcacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6241 - RNA, 1892 nt, Artificial Sequence
  mRNA product Design3 comprising derived and/or modified sequence from Lassa virus__AIT17821__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgguggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacggucguggaccucgaguccgacggcaagccccagaagaccggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccguggaggucgcgcucuaccagcccuccagcggcugcuacauccacuucuuccgggagccgaccgaccugaagcaguucaagcaggacgccaaguacucccacgggaucgacgugaccgaccuguucgccgcccagcccggccucacgagcgccgugaucgacgcgcugccccgcaacauggucaucacgugccagggcuccgacgacauccgcaagcugcucgagagccaggggcggaaggacaucaagcugaucgacaucgcccugagcaagaccgacucccgcaaguacgagaacgccgugugggaccaguacaaggaccucugccacaugcacaccggcgucgugguggagaagaagaagcgcgggggcaaggaggagaucaccccgcacugcgcccugauggacugcaucauguucgacgcggccgucagcgggggccugaacaccuccgugcuccgggccgugcugccccgggacauggucuuccgcaccagcacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6242 - RNA, 1892 nt, Artificial Sequence
  mRNA product Design3 comprising derived and/or modified sequence from Lassa virus__AIT17837__NP (opt1)
gggagaaagcuuaccaugagcaacuccaaggagaucaagagcuuccuguggacccagucccuccgccgggagcugagcggcuacugcuccaacaucaagcuccagguggucaaggacgcccaggcccugcugcacgggcuggacuucagcgagguguccaacgugcagcgccucaugcggaagcagaagcgcgacgacgcggaccugaagcggcugcgcgaccucaaccaggccgucaacaaccugguggagcucaagagcacccagcagaagaacgugcugcgggucggcacgcuguccagcgacgaccugaucacccucgccgccgaccuggagaagcugaaguccaaggugauccgcaccgagcggccccucagcuccgggguguacaugggcaaccugagcucccagcagcuggaccagcgccgggcccuccugagcaugaucgggauguccggcggcccgcaggggaaccgcaccggcggggacggcgucgugcgggugugggacgucaagaacgcggagcugcucaacaaccaguucgggacgaugcccagccugacccuggccugccucaccaagcagggccagguggaccugaacgacgccgugcaggcccugaccgaccucggccugaucuacacggcgaaguaccccaacuccagcgaccuggacaugcucacccagagccaccccauccuggggauggucgacaccaagaaguccagccugaacaucuccggcuacaacuucagccucggggccgccgugaaggccggcgccugcaugcuggacggcgggaacaugcuggagaccaucaagguguccccgcagacgauggacggcauccucaagagcauccugaaggucaagcgcucccuggggauguucaucagcgacacccccggcgagcggaaccccuacgagaacauccucuacaagaucugccuguccggggagggcuggcccuacaucgcgagccgcaccuccaucaccggccgggccugggagaacacgcugguggaccucgagagcgacaacaagccgcccaagcugaacuccgccgggagcaacaagucccugcaggccgccggccucaacgcggggcugaccuacagccagcugaugacccugaaggacugcaugcuccagcuggaccccuccagcaagaccuggaucgacaucgagggccgccccgaggacccgguggagaucgcccuguuccagcccuccagcgggugcuacauccacuucuuccgggagcccacggaccucaagcaguucaagcaggacgccaaguacagccacggcaucgacgucaccgaccuguucuccacccagcccggccugaccagcgccgugaucgaggcccucccgcgcaacauggugcugacgugccagggguccgacgacaucaagaagcugcucgagagccagggccggcgcgacaucaagcugaucgacaucucccugagcaaggcggacucccgcaaguucgagaacgccgucugggaccaguacaaggaccucugccacaugcacaccgggguggucguggagaagaagaagcggggcgggaaggaggagaucacgccccacugcgcccugcuggacugcaucauguucgacgccgccaccaccggcagccucaacaucaccacccugcgcgcggugcugccccgggacauggucuuccgcaccuccacgcccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6243 - RNA, 1892 nt, Artificial Sequence
  mRNA product Design3 comprising derived and/or modified sequence from Lassa virus__AIT17841__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggacggggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcccagcccggccucacgagcgcggucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacaccuccgugcugcgggccgugcucccccgggacauggucuuccgcaccagcacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6244 - RNA, 1892 nt, Artificial Sequence
  mRNA product Design3 comprising derived and/or modified sequence from Lassa virus__AIT17845__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccagacggggcgggacggcgugguccgcgugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccggcugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgccucccggaccagcaucacgggccgcgcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugaccgaccuguucgccgcccagcccggccucacgagcgcggucaucgacgcccugccccggaacauggugaucacgugccagggcuccgacgacauccgcaagcuguucgagagccaggggcgcaaggacaucaagcucaucgacaucgcccugagcaagaccgacucccggaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacaccuccgugcugcgggccgugcucccccgcgacauggucuuccggaccagcacgccccgcguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6245 - RNA, 1892 nt, Artificial Sequence
  mRNA product Design3 comprising derived and/or modified sequence from Lassa virus__ANH09723__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucacccuggccgccgaccuggagaagcucaaguccaaggugacccggacggagcgcccccugaccgccgggguguacaugggcaaccugagcucccagcagcucgaccagcggcgcgcgcugcugaacaugaucgggaugagcggcggcaaccagggggcccggaccggccgcgacggggucgugcgggugugggacgucaagaacgccgagcuccugaacaaccaguucggcaccaugccgucccugacgcucgccugccugaccaagcagggccagguggaccugaacgacgugguccaggcgcucaccgaccuggggcugaucuacaccgccaaguaccccaacacgagcgaccucgaccgccugacccagucccaccccauccugaacaugaucgacaccaacaagagcucccucaacaucagcggcuacaacuucagccugggggccgccgugaaggccggcgcgugcaugcuggacgggggcaacaugcucgagaccaucaaggugagcccccagacgauggacggcauccucaagagcauccugaaggucaagaagucccuggggauguucaucagcgacaccccgggcgagcggaaccccuacgagaacauccuguacaagaucugccuguccggggacggcuggcccuacaucgccagccgcaccuccaucaccgggcgggccugggagaacacggugguggaccucgagagcggcggcaagccccagaaggccggguccaacaacagcaacaagucccugcagagcgccggcuucgcggccgggcugaccuacucccagcucaugacccugaaggacgccaugcugcagcuggacccgaacgccaagaccuggauggacaucgagggccgccccgaggaccccgucgagaucgcccucuaccagcccaucagcgggugcuacauccacuucuuccgggagccgacggaccugaagcaguucaagcaggacgcgaaguacucccacggcaucgacgugaccgaccuguucgccgcccagcccggccucaccagcgccgugaucgaggcccugccccgcaacauggucaucacgugccagggguccgacgacauccgcaagcuguucgagagccagggccggaaggacaucaagcucaucgacaucgcgcuguccaagaccgacagccgcaaguacgagaacgccgugugggaccaguacaaggaccugugccacaugcacaccggggucgugguggagaagaagaagaagggcgggaaggaggagaucacgccccacugcgcccucauggacugcaucauguucgacgccgcggucagcggcggccugaacacccuggugcuccgggccgugcugccgcgcgacauggucuuccggaccuccacccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6246 - RNA, 1892 nt, Artificial Sequence
  mRNA product Design3 comprising derived and/or modified sequence from Lassa virus__ANH09725__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgaccuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaacaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaagucccucgggauguucaucagcgacaccccgggcgagcggaaccccuacgagaacauccuguacaagaucugccugagcggggacggcuggcccuacaucgccucccgcaccagcaucacggggcgggccugggagaacaccgugguggaccucgaguccggcggcaagccccagaaggccgggagcaacaacuccaacaagagccugcaguccgcgggcuucgccgccgggcugaccuacagccagcucaugacccugaaggacgccaugcugcagcuggacccgaacgccaagacguggauggacaucgagggccgccccgaggaccccgucgagaucgcgcucuaccagcccaucuccgggugcuacauccacuucuuccgggagccgaccgaccugaagcaguucaagcaggacgccaaguacagccacggcaucgacgugaccgaccuguucgccgcccagcccggccucaccuccgccgugaucgaggcgcugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccggggucgugguggagaagaagaagcggggcgggaaggaggagaucacgccccacugcgcccugauggacugcaucauguucgacgcggccgucuccggcggccugaacacccucgugcugcgcgccgugcugccgcgggacauggucuuccgcaccagcacccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6247 - RNA, 1892 nt, Artificial Sequence
  mRNA product Design3 comprising derived and/or modified sequence from Lassa virus__ANH09729__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccuccgacgaccugcucacccuggccgccgaccuggagaagcucaagagcaaggugacccggacggagcgcccccuguccgccgggguguacaugggcaaccugagcucccagcagcucgaccagcggcgcgcgcugcugaacaugaucgggaugagcggcggcaaccagggggcccggaccggccgcgacggggucgugcgggugugggacgucaagaacgccgaccuccugaacaaccaguucggcaccaugccgucccugacccucgccugccugacgaagcagggccagguggaccugaacgacgugguccaggcgcucaccgaccuggggcugaucuacaccgccaaguaccccaacaccagcgaccucgaccgccugacgcagucccaccccauccugaacaugaucgacaccaacaagagcagccucaacaucuccggcuacaacuucagccugggggccgccgugaaggccggcgcgugcaugcuggacgggggcaacaugcucgagaccaucaaggugagcccccagaccauggacggcauccucaagagcauccugaaggucaagaagucccuggggauguucaucagcgacacgccgggcgagcggaaccccuacgagaacauccuguacaagaucugccuguccggggacggcuggcccuacaucgccagccgcaccuccaucaccgggcgggccugggagaacaccgugguggaccucgagagcggcggcaagccccagcgcgccggguccaacaacagcaacaagucccugcagagcgccggcuucgcggccgggcugacguacucccagcucaugacccugaaggacgccaugcugcagcuggacccgaacgccaagaccuggauggacaucgagggccggcccgaggaccccgucgagaucgcccucuaccagcccaccagcgggugcuacauccacuucuuccgcgagccgacggaccugaagcaguucaagcaggacgcgaaguacucccacggcaucgacgugaccgaccuguucgccgcccagcccggccucaccagcgccgugaucgaggcccugccccgcaacauggucaucacgugccagggguccgacgacauccggaagcugcucgagagccagggccgcaaggacaucaagcugaucgacaucgcgcugagcaagaccgacucccggaaguacgagaacgccgugugggaccaguacaaggaccucugccacaugcacaccggggucgugguggagaagaagaagaagggcgggaaggaggagaucacgccccacugcgcccugauggacugcaucauguucgacgccgcggucagcggcggccugaacacccucgugcugcgcgccgugcugccgcgggacauggucuuccgcaccuccacccccaagguggugcucugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6248 - RNA, 1892 nt, Artificial Sequence
  mRNA product Design3 comprising derived and/or modified sequence from Lassa virus__ANH09731__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucacccuggccgccgaccuggagaagcucaaguccaaggugacccggacggagcgcccccugagcgccgggguguacaugggcaaccuguccagccagcagcucgaccagcggcgcgcgcugcugaacaugaucgggaugaccggcggcaaccagggggcccggaccggccgcgacggggucgugcgggugugggacgucaagaacgccgaccuccugaacaaccaguucggcaccaugccgucccugacgcucgccugccugaccaagcagggccagguggaccugaacgacgugguccaggcgcucaccgaccuggggcugaucuacaccgccaaguaccccaacacgagcgaccucgaccgccugacccagucccaccccauccugaacaugaucgacaccaacaagagcucccucaacaucagcggcuacaacuucagccugggggccgccgugaaggccggcgcgugcaugcuggacgggggcaacaugcucgagaccaucaaggugagcccccagacgauggacggcauccucaagagcauccugaaggucaagaagucccuggggauguucaucagcgacaccccgggcgagcggaaccccuacgagaacauccuguacaagaucugccuguccggggacggcuggcccuacaucgccagccgcaccuccaucaccgggcgggccugggagaacacggugguggaccucgagagcggcggcaagccccagcgcgccggguccaacaacagcaacaagucccugcagagcgccggccuggcggccgggcucaccuacucccagcugaugacccugaaggacgccaugcugcagcucgacccgaacgccaagaccuggauggacaucgagggccggcccgaggaccccgucgagaucgcccuguaccagcccacgagcgggugcuacauccacuucuuccgcgagccgaccgaccugaagcaguucaagcaggacgcgaaguacucccacggcaucgacgugaccgaccucuucgccgcccagcccggccugaccagcgccgugaucgaggcccugccccgcaacauggucaucacgugccagggguccgacgacauccggaagcuccuggagagccagggccgcaaggacaucaagcugaucgacaucgcgcucuccaagaccgacagccggaaguacgagaacgccgugugggaccaguacaaggaccugugccacaugcacaccggggucgugguggagaagaagaagaagggcgggaaggaggagaucacgccccacugcgcccugauggacugcaucauguucgacgccgcggucagcggcggccucaacacccuggugcugcgcgccgugcucccgcgggacauggucuuccgcaccuccacccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6249 - RNA, 1892 nt, Artificial Sequence
  mRNA product Design3 comprising derived and/or modified sequence from Lassa virus__ANH09733__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucacccuggccgccgaccuggagaagcucaaguccaaggugacccggacggagcgcccccugagcgccgggguguacaugggcaaccuguccagccagcagcucgaccagcggcgcgcgcugcugaacaugaucgggauguccggcggcaaccagggggcccggaccggccgcgacggggucgugcgggugugggacgucaagaacgccgaccuccugaacaaccaguucggcaccaugccgagccugacccucgccugccugacgaagcagggccagguggaccugaacgacgugguccaggcgcucaccgaccuggggcugaucuacaccgccaaguaccccaacaccuccgaccucgaccgccugacgcagagccaccccauccugaacaugaucgacaccaacaaguccagccucaacaucagcggcuacaacuucucccugggggccgccgugaaggccggcgcgugcaugcuggacgggggcaacaugcucgagaccaucaaggugagcccccagaccauggacggcauccugaaguccauccugaaggucaagaagucccucgggauguucaucagcgacacgccgggcgagcggaaccccuacgagaacauccuguacaagaucugccugagcggggacggcuggcccuacaucgccucccgcaccagcaucaccgggcgggccugggagaacaccgugguggaccucgaguccggcggcaagccccagcgcgccgggagcaacaacuccaacaagagccugcaguccgccggcuucgcggccgggcugacguacagccagcucaugacccugaaggacgccaugcugcagcuggacccgaacgccaagaccuggauggacaucgagggccggcccgaggaccccgucgagaucgccuucuaccagcccaucuccgggugcuacauccacuucuuccgcgagccgaccgaccucaagcaguucaagcaggacgcgaaguacagccacggcaucgacgugacggaccuguucgccgcccagcccggccugaccuccgccgugaucgaggcccucccccgcaacauggucaucacgugccaggggagcgacgacauccggaagcugcuggagucccagggccgcaaggacaucaagcucaucgacaucgcgcugagcaagaccgacagccggaaguacgagaacgccgugugggaccaguacaaggaccugugccacaugcacaccggggucgugguggagaagaagaagaagggcgggaaggaggagaucacgccccacugcgcccucauggacugcaucauguucgacgccgcggucuccggcggccugaacacccuggugcuccgcgccgugcugccgcgggacauggucuuccgcaccagcacccccaagguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6250 - RNA, 1892 nt, Artificial Sequence
  mRNA product Design3 comprising derived and/or modified sequence from Lassa virus__ANH09735__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacgaacggcggccagggggcgaacgccggccgggacgggaucguccgcgugugggacgugaagaacgccgagcuccugaacaaccaguucggcaccaugcccucccugacccucgccugccugaccaagcaggggcaggucgaccugaacgacgcggugcaggcccucacggaccugggccugaucuacaccgccaaguaccccaacagcuccgaccucgaccggcugagccagaaccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagacgauggacggcauccugaaguccauccugaaggugaagcgcagccucgggauguucguguccgacaccccgggcgagcggaaccccuacgagaacauccuguacaagaucugccugagcggggacggcuggcccuacgucgccucccgcaccagcaucaucgggcgggccugggagaacaccgugguggaccucgaguccgacagcaagccccagcgcccgggcuccaaggagagcaaccggucccugcagacggccggcuuccccgcggggcugaccuacagccagcucaugacccugaaggacuccaugcugcagcuggaccccaacgccaagaccuggauggacaucgagggccgccccgacgacccggucgagaucgcccucuaccagcccagcuccgggugcuacauccacuucuuccgcgagcccacggaccugaagcaguucaagcaggacgccaaguacagccacggcaucgacaucggggaccuguucgccgcgcagcccggccucaccagcgccgugaucgaggcccugccgcggaacauggugaucacgugccagggcuccgaggacaucaagcgccugcucgagagccaggggcggaaggacauccgccuggucgacaucucccugagcaaggccgacucccggaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgcgcggugcugcccaaggacauggucuuccggaccagcacgccccgcguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6251 - RNA, 1892 nt, Artificial Sequence
  mRNA product Design3 comprising derived and/or modified sequence from Lassa virus__ANH09737__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacgaacggcggccagggggcgaacgccggccgggacgggaucguccgcgugugggacgugaagaacgccgagcuccugaacaaccaguucggcaccaugcccucccugacccucgccugccugaccaagcaggggcaggucgaccugaacgacgcggugcaggcccucacggaccugggccugaucuacaccgccaaguaccccaacagcuccgaccucgaccggcugagccagaaccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagacgauggacggcauccugaaguccauccugaaggugaagcgcagccucgggauguucguguccgacaccccgggcgagcggaaccccuacgagaacauccuguacaagaucugccugagcggggacggcuggcccuacgucgccucccgcaccagcaucaucgggcgggccugggagaacaccgugguggaccucgaguccgacagcaagccccagcgcccgggcuccaaggagagcaaccggucccugcagacggccggcuuccccgcggggcugaccuacagccagcucaugacccugaaggacuccaugcugcagcuggaccccaacgccaagaccuggauggacaucgagggccgccccgacgacccggucgagaucgcccucuaccagcccagcuccgggugcuacauccacuucuuccgcgagcccacggaccugaagcaguucaagcaggacgccaaguacagccacggcaucgacaugggggaccuguucgccgcgcagcccggccucaccagcgccgugaucgaggcccugccgcggaacauggugaucacgugccagggcuccgaggacaucaagcgccugcucgagagccaggggcggcgcgacauccggcuggucgacaucucccugagcaaggccgacucccgcaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgggcggugcugcccaaggacauggucuuccgcaccagcacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6252 - RNA, 1892 nt, Artificial Sequence
  mRNA product Design3 comprising derived and/or modified sequence from Lassa virus__ANH09739__NP (opt1)
gggagaaagcuuaccaugagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacguccggcggccagggggcgaacgccggccgggacgggaucguccgcgugugggacgugaagaacgccgagcuccugaacaaccaguucggcaccaugcccagccugacccucgccugccugaccaagcaggggcaggucgaccugaacgacgcggugcaggcccucacggaccugggccugaucuacaccgccaaguaccccaacuccagcgaccucgaccggcugagccagaaccaccccauccugaacaugaucgacaccaagaaguccagccucaacaucuccggcuacaacuucagccugggggccgccgugaaggcgggcgccugcaugcuggacgggggcaacaugcucgagaccaucaaggucagcccccagacgauggacggcauccucaagagcauccugaaggugaagcgcucccuggggauguucgugagcgacaccccgggcgagcggaaccccuacgagaacauccuguacaagaucugccuguccggggacggcuggcccuacgucgccagccgcaccuccaucaucgggcgggccugggagaacaccgugguggaccucgagagcgacuccaagccccagcgcccgggcagcaaggaguccaaccggagccugcagacggccggcuuccccgcggggcugaccuacucccagcucaugacccugaaggacagcaugcugcagcuggaccccaacgccaagaccuggauggacaucgagggccgccccgacgacccggucgagaucgcccucuaccagcccuccagcgggugcuacauccacuucuuccgcgagcccacggaccugaagcaguucaagcaggacgccaaguacagccacggcaucgacaucggggaccuguucgccgcgcagcccggccucaccuccgccgugaucgaggcccugccgcggaacauggugaucacgugccagggcagcgaggacaucaagcgccugcucgagucccaggggcggcgcgacauccggcuggucgacaucagccuguccaaggccgacagccgcaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgggcggugcugcccaaggacauggucuuccgcaccuccacgccccggguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6253 - RNA, 1892 nt, Artificial Sequence
  mRNA product Design3 comprising derived and/or modified sequence from Lassa virus__ANH09741__NP (opt1)
gggagaaagcuuaccaugagcaacuccaaggaggugaaguccuuccuguggacccagagccuccgccgggagcugagcggcuacugcaccaacaucaagcugcaggucgugaaggacgcccaggcccuccugcacgggcuggacuucuccgaggugagcaacguccagcgccucaugcggaagcagaagcgcgacgacaacgaccugaagcggcugcgcgaccucaaccaggcggugaacaaccugguggagcugaaguccguccagcagaaguccgugcucaaggugggcacgcugaacagcgacgaccugcucacccuggccgccgaccuggagaagcucaagagcaaggucgugcggaccgagcgcccccuguccagcgggguguacaugggcaaccuguccagccagcagcucgaccagcggcgcgcccugcugaacaugaucgggauggccggcggcucccaggggaaccagccgagccgggacggcgucgugcgcgugugggacgucaagaacgcggaccuccugaacaaccaguucgggaccaugcccucccugacgcucgccugccugaccaagcagggccagguggaccugaacgacgugguccucgcccugaccgaccuggggcucaucuacaccgccaaguaccccaacagcuccgaccuggaccggcugagccagaaccaccccgugcucaacaugaucgacgugaacaagagcucccugaacaucagcggcuacaacuucucccugggcgcggccgucaaggccggggccugcaugcucgacggcgggaacaugcuggagacgaucaagaucagcccgcagaccguggacggcauccugaaguccauccucaaggugaagcgcgcccugggcauguucgucagcgacacccccggggagcggaaccccuacgagaacauccuguacaaggugugccucuccggcaacggguggcccuacaucgcgagccgcaccuccaucgucggccgggccugggagaacacggugguggaccuggagagcaacaagaaccagccgaaggucgggaacaacggcuccaacaagaugcugcagagcuccggcuucgccaccgggcucaccuacagccagcugaugacccugcgcgacuccaugcugcagcucgaccccacggccaagaccuggaucgacaucgagggccggcccgaggaccccguggagcuggcccuguuccagccgagcuccgggugcuacauccacuucuuccgcgagcccaccgaccucaagcaguucaagcaggacgcgaaguacagccacggcaucgacgugaacgaccuguucuccgcccagcccgggcugaccagcgccguccucgaggcccugccccggaacauggugcugacgugccagggcagcgacgacauccgcaagcuccuggacucccaggaccgcaaggacaucaagcugaucgacaucagccucuccaaggccgacgcgcggaaguucgagaacgacgugugggaccaguucaaggaccugugccacaugcacaccggcaucgucguggagaagaagaagaagggcgggaagcaggagaugaccccgcacugcgcccugcucgacugcaucauguucgacgccgccgugagcgggggccugaacguccccacccugcgcgccgugcuccccacggacaugguguuccggaccaucaccaccaaggucgugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6254 - RNA, 1895 nt, Artificial Sequence
  mRNA product Design3 comprising derived and/or modified sequence from Lassa virus__CAA36646__NP (opt1)
gggagaaagcuuaccaugagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagaagcgggacgacggcgaccugaagcgccugcgggaccucaaccaggccgugaacaaccugguggagcucaagagcacccagcagaaguccguccugcgcguggggacccugagcuccgacgaccugcucauccuggccgccgaccuggagaagcucaagagcaaggugacccggaccgagcgcccccuguccagcggcgucuacauggggaaccuguccagccagcagcucgaccagcggcgcgcccugcugaacaugaucggcaugaccggcguguccgggggcgggaagggcgcgagcgacgggaucgugcgggucugggacgugaagaacgccgagcuccugaacaaccaguucggcacgaugccgucccugacccucgccugccugaccaagcagggccagguggaccugaacgacgccguccaggcgcucaccgaccuggggcugaucuacacggccaaguaccccaacagcagcgaccucgaccgccugucccagagccaccccauccugaacaugaucgacaccaagaaguccagccucaacaucuccggcuacaacuucagccugggggccgccgugaaggccggcgcgugcaugcuggacggcgggaacaugcucgagaccaucaaggugagcccccagaccauggacggcauccucaaguccauccugaaggucaagaagucccuggggauguucgugagcgacacgccgggcgagcggaaccccuacgagaacauccuguacaagaucugccuguccggggacggcuggcccuacaucgccagccgcaccuccaucgugggccgggccugggagaacaccgucguggaccucgagcaggacaacaagccccagaagaucgggaacggcgggagcaacaagucccugcagagcgccggcuucgccgcggggcugaccuacucccagcucaugacgcugaaggacuucaagugcuucaaccugaucccgaacgccaagaccuggauggacaucgagggccgccccgaggaccccguggagaucgcccuguaccagcccagcuccggcugcuacguccacuucuuccgggagccgaccgaccucaagcaguucaagcaggacgccaaguacagccacgggaucgacgugaccgaccuguucgccgcgcagcccggccugacgagcgccgucaucgaggcccucccccgcaacauggugaucacgugccagggguccgaggacauccggaagcugcuggagagccagggccgccgcgacaucaagcucaucgacaucacccuguccaaggccgacagccggaaguucgagaacgccgugugggaccaguucaaggaccugugccacaugcacaccggggucgugguggagaagaagaagcgcggcggcaaggaggagaucacgccccacugcgcgcucauggacugcaucauguucgacgccgccgucuccgggggccuggacgccaaggugcugcgggugguccucccgcgcgacaugguguuccggaccagcacccccaaggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6255 - RNA, 1892 nt, Artificial Sequence
  mRNA product Design3 comprising derived and/or modified sequence from Lassa virus__CCA30315__NP (opt1)
gggagaaagcuuaccaugagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacagcgaccugaagcgccugcgggaccucaaccaggccgugaacaaccugguggagcugaaguccacccagcagaaguccguccuccgcgugggcacgcugagcagcgacgaccugcucacccuggccgccgaccuggagaagcucaaguccaaggugacccggaccgagcgcccccugagcuccggggucuacaugggcaaccugagcucccagcagcucgaccagcggcgcgcccugcugaaccucaucgggaugacgaacggcagccagggcucccaggcggggcgggacggcguggugcgcgucugggacgugaagaacgccgagcugcugaacaaccaguucgggaccaugccgagccucacccuggccugccugaccaagcagggccagguggaccucaacgacgucgugcaggcccugacggaccuggggcucaucuacaccgcgaaguaccccaacaccagcgaccuggaccggcugacccagucccaccccauccucaacaugaucgacacgaagaaguccagccugaacaucagcggcuacaacuucucccugggcgccgccgugaaggccggggccugcaugcucgacggcgggaacaugcuggagaccaucaaggucagcccccaguccauggacggcauccucaagagcauccugaaggugaagcgcgcgcugggcauguucguguccgacaccccgggggagcggaaccccuacgagaacauccuguacaagaucugccucagcggcgacggguggcccuacaucgccucccgcaccagcaucgucggccgggccugggagaacacggugguggaccuggagaccgacgggaagccccagaagaucggcuccggcaacagcaacaagucccugcagagcgccggguucuccgccggccucaccuacagccagcugaugacccugaaggacgcgaugcugcagcucgacccgaacgccaagacguggauggacaucgaggggcgccccgaggaccccgucgagguggcccuguaccagcccaucuccggcugcuacauccacuucuuccgggagccgaccgaccugaagcaguucaagcaggacgccaaguacagccacgggaucgacaucgccgaccucuucgcggcccagcccggccugaccagcgccgucaucgaggcccugccccgcaacauggugaucacgugccagggcuccgaggacaucaagaagcuccuggagagccaggggcgcaaggacaucaagcugaucgacaucgcccucuccaagaucgacagccggaaguucgagaacgcggugugggaccaguacaaggaccugugccacaugcacaccggcgucgugguggagaagaagaagcgcgggggcaaggaggagaucaccccgcacugcgcccugauggacugcaucauguucgacgccgccgucuccgggggccucaacacccuggugcugcgggcggugcucccccgcgacauggucuuccggaccagcacgccccgcguggugcugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6256 - RNA, 1892 nt, Artificial Sequence
  mRNA product Design3 comprising derived and/or modified sequence from Lassa virus__JX985061__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6257 - RNA, 1892 nt, Artificial Sequence
  mRNA product Design3 comprising derived and/or modified sequence from Lassa virus__NP_694869__NP (opt1)
gggagaaagcuuaccaugagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcaccaugccgagccugacgcucgcgugccugaccaagcaggggcaggucgaccugaacgacgccgugcaggcccucaccgaccugggccugaucuacaccgccaaguaccccaacacguccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagaccaucaaggucagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacgguggucgaccucgagagcgacggcaagccccagaaggccgacuccaacaacagcuccaagagccugcaguccgccggcuucaccgccgggcugaccuacagccagcucaugacccugaaggacgccaugcugcagcuggacccgaacgcgaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgugaccgaccuguucgccacccagcccgggcucacgagcgccgucaucgacgcgcugccccgcaacauggugaucacgugccagggcuccgacgacauccgcaagcugcucgagagccagggccggaaggacaucaagcugaucgacaucgcccugagcaagaccgacucccgcaaguacgagaacgccgugugggaccaguacaaggaccucugccacaugcacaccggggucguggucgagaagaagaagcggggcgggaaggaggagaucaccccgcacugcgcccugauggacugcaucauguucgacgcggccgugagcggcgggcugaacaccuccgugcuccgcgccguccugccccgggacaugguguuccgcaccagcacgccccgggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6258 - RNA, 1892 nt, Artificial Sequence
  mRNA product Design3 comprising derived and/or modified sequence from Lassa virus__SCA79106__NP (opt1)
gggagaaagcuuaccaugagcaacuccaaggaggugaaguccuuccuguggacccagagccuccgccgggagcugagcggcuacugcuccaacaucaagcugcaggucgugaaggacgcccaggcccuccugcacgggcuggacuucagcgagguguccaacguccagcgccucaugcggaagcagaagcgcgacgacggcgaccugaagcggcugcgcgaccucaaccaggcggugaacaaccugguggagcucaagagcguccagcagaaguccauccugcggguggggacccugaccagcgacgaccugcucacccuggccgccgaccuggagaagcucaaguccaaggugacccgcaccgagcggccccugagcuccggcgucuacauggggaaccugagcucccagcagcucgaccagcgccgggcccugcugagcaugaucggcauguccggcgggaaccagaacagccagccgaagggcgacgggguggugcgcgucugggacgugaagaacgccgaccuccugaacaaccaguucggcacgaugcccucccugacccucgcgugccugaccaagcagggccagguggaccugaacgacgccguccaggcccucaccgaccuggggcugaucuacacggccaaguaccccaacagcagcgaccucgaccggcugucccagagccaccccauccugaacaugaucgacaccaagaaguccagccucaacaucuccggcuacaacuucagccugggggcggccaucaagaccggcgccugcaugcuggacgggggcaacaugcucgagaccaucaaggugacgccgcagaccauggacggcauccugaaguccauccugaaggugaagcgcagccucgggauguucaucuccgacacccccggcgagcggaaccccuacgagaacauccuguacaagaucugccugagcggggacggcuggcccuacaucgccucccgcaccgccaucaucgggcgggcgugggagaacacggucguggaccucgagagcgacuccaagccgcagaagaucggcagcaacggcuccaacaagagccugcaguccgccggguucgcccccggccugaccuacagccagcucaugacccugaaggacuccaugcugcagcuggaccccaacgccaagaccuggaucgacaucgaggggcgccccgaggacccgguggaggucgcccucuuccagcccaucagcggcugcuacauccacuucuuccgggagcccacggaccugaagcaguucaagcaggacgcgaaguacagccacgggaucgacgugaccgaccuguucgccgcccagcccggccucaccuccgccgugaucgaggcccugccgcgcaacaugguccugaccugccagggcagcgacgacaucaagaagcuccuggacucccaggggcggcgcgacaucaagcugaucgacgugagccucaacaagaucgacucccgcaaguucgagaacgcggucugggaccaguacaaggaccugugccacaugcacacgggcgugguggucgagaagaagaagaagggcgggaaggaggagaucacgccccacugcgcccugcucgacugcaucauguucgacgccgccgugagcgggggccugaacgccaccgugcugcgggcgguccucccccgcgacaugguguuccggaccuccagccccaaggugguccugugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6259 - RNA, 482 nt, Artificial Sequence
  mRNA product Design3 comprising derived and/or modified sequence from Lassa virus__ADY11072__Z (opt1)
gggagaaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccgcugcccacgaagcuccgccccagcgccgcccccaccgccccgcccaccggggcggccgacuccauccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6260 - RNA, 482 nt, Artificial Sequence
  mRNA product Design3 comprising derived and/or modified sequence from Lassa virus__AAO59514__Z (opt1)
gggagaaagcuuaccaugggcaacaagcagguccgcagcaugaagaagguggacagcccccgggccucccugauccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugccgaccaagcucaagaccuccacgacccccaccgcgcccagcauccgcgaggccaacaccacgagcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6261 - RNA, 482 nt, Artificial Sequence
  mRNA product Design3 comprising derived and/or modified sequence from Lassa virus__AAO59508__Z (opt1)
gggagaaagcuuaccaugggcaaccgccaggccaagaaccccgagguggagaacagcccccgggccucccugauccccgacgcgacccaccucgggccccaguucugcaagagcugcugguucgagaacaagggccuggucgagugcaacaaccacuaccugugccucaacugccugucccugcuccugagcguguccaaccgcugccccaucugcaagaugccgcugcccacccggcuccgccccacgaccacccccaccgccccgcagaucaucaaggagaacacgaccaacccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6262 - RNA, 482 nt, Artificial Sequence
  mRNA product Design3 comprising derived and/or modified sequence from Lassa virus__AAO59510__Z (opt1)
gggagaaagcuuaccaugggcaacaagcagaccaaggcccccgaggccaaggacagcccgcgcgcgucccugauccccgacgccaccuaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgcgggggccgcccacagcgcccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6263 - RNA, 482 nt, Artificial Sequence
  mRNA product Design3 comprising derived and/or modified sequence from Lassa virus__AAT48997__Z (opt1)
gggagaaagcuuaccaugggcaacaagcaggccaaggcccccgagaccaagaacagcccccgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgugcccaccgccccgcccgcccaggugggggaccggacccgcccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6264 - RNA, 482 nt, Artificial Sequence
  mRNA product Design3 comprising derived and/or modified sequence from Lassa virus__AAT49005__Z (opt1)
gggagaaagcuuaccaugggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccacccgccuccggcccuccgccgugcccaccgccccgcccgcccccgcgggggaccgcaccaagcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6265 - RNA, 482 nt, Artificial Sequence
  mRNA product Design3 comprising derived and/or modified sequence from Lassa virus__ADU56612__Z (opt1)
gggagaaagcuuaccaugggcaaccgccagacccggcccaccgaggccacggagcagagccgcgcccaccuggugccggacgccucccaccucgggccccaguucugcaagagcugcugguucgagaaccggggccuggucgagugcaacaaccacuaccugugccucaacugccugucccugcuccugagcguguccagccgcugccccaucugcaagaugccccugccgacccggcucaaggccuccgcccagcccagcgccccgcccaccgaggcgccccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6266 - RNA, 482 nt, Artificial Sequence
  mRNA product Design3 comprising derived and/or modified sequence from Lassa virus__ADU56616__Z (opt1)
gggagaaagcuuaccaugggcgggaagcacaccaagcagccccgcgagagcaacuccccgcgggccagccugauccccgacgccacccaccucggcccccaguucugcaaguccugcugguucgagaacaaggggcugguggagugcaacaaccacuaccugugccucaacugccugagccugcuccuguccgucagcaaccgcugccccaucugcaagaugccccugcccacgcggcuccgcaccuccaccaaccccaccgcgccccagguggagcagacgggcccggccagcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6267 - RNA, 482 nt, Artificial Sequence
  mRNA product Design3 comprising derived and/or modified sequence from Lassa virus__ADU56620__Z (opt1)
gggagaaagcuuaccaugggcgggaagcacaccaagccccagcgcgagagcaacuccccgcgggccagccugauccccgacgccacccaccucggcccccaguucugcaaguccugcugguucgagaacaaggggcugguggagugcaacaaccacuaccugugccucaacugccugacgcugcuccugagcguguccaaccgcugccccaucugcaagaugccccugcccacccggcuccgcgccagcaccaaccccaccgcgccccagguggagcaggucggcccgacgaacccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6268 - RNA, 482 nt, Artificial Sequence
  mRNA product Design3 comprising derived and/or modified sequence from Lassa virus__ADU56624__Z (opt1)
gggagaaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6269 - RNA, 482 nt, Artificial Sequence
  mRNA product Design3 comprising derived and/or modified sequence from Lassa virus__ADU56628__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6270 - RNA, 482 nt, Artificial Sequence
  mRNA product Design3 comprising derived and/or modified sequence from Lassa virus__ADU56632__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgacccaggacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6271 - RNA, 482 nt, Artificial Sequence
  mRNA product Design3 comprising derived and/or modified sequence from Lassa virus__ADU56644__Z (opt1)
gggagaaagcuuaccaugggcaaccgccagaccaaggcccccgaggccaaggggagcccccgggcgucccugauccccgacgccacccaccucggcccccaguucugcaagagcugcugguucgagaacaaggggcugguggagugcaacgaccacuaccugugccucaacugccugacgcugcuccuguccgucagcucccgcugccccaucugcaagaugccgcugcccacccggcuccgccccagcaccaaccccaccgccccgcccgcccgggccgagggcgggaucaacccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6272 - RNA, 482 nt, Artificial Sequence
  mRNA product Design3 comprising derived and/or modified sequence from Lassa virus__AHC95545__Z (opt1)
gggagaaagcuuaccaugggcaacaagcaggccaaggaccccaagaccgagagcuccccgcgcgccagccugauccccgacgcgacccaccucgggccccaguucugcaaguccugcugguucgagaacaagggccugguggagugcaacaaccacuaccugugccucaacugccugagccugcuccuguccgucagcaaccggugccccaucugcaagaugccccugcccacgaagcucaagcccaucaccacccccaccgccccgcagaucacgcgcgaguccaucaccaacccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6273 - RNA, 482 nt, Artificial Sequence
  mRNA product Design3 comprising derived and/or modified sequence from Lassa virus__AHC95547__Z (opt1)
gggagaaagcuuaccaugggcaaccgccaggccaaggaccccaagguggagagcuccccgcgggccagccugauccccgacgcgacccaccucgggccccaguucugcaaguccugcugguucgagaacaagggccuggucgagugcaacaaccacuaccugugccucaacugccugagccugcuccuguccgugagcaaccgcugccccaucugcaagaugccccugcccacccggcuccgccccacgaccaugcccaccgccccgcagaucaucaaggaggggaccacgaacccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6274 - RNA, 482 nt, Artificial Sequence
  mRNA product Design3 comprising derived and/or modified sequence from Lassa virus__AIT17124__Z (opt1)
gggagaaagcuuaccaugggcaacaagcaggucaagacccccgaggccaaggacagcccccgcgccucccugauccccgacgcgacccaccucgggccccaguucugcaagagcugcugguucgagaacaagggccugguggagugcaacaaccacuaccugugccucaacugccugacgcugcuccuguccguggggaaccggugccccaucugcaagaugccgcugcccaccaagcuccgccccagcgugacccccaccgccccgcccacgcgggccgccgacuccaucggcccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6275 - RNA, 482 nt, Artificial Sequence
  mRNA product Design3 comprising derived and/or modified sequence from Lassa virus__AIT17128__Z (opt1)
gggagaaagcuuaccaugggcaacaagcaggccaagacccccgaggccaaggacagcccgcgcgcgaaccugauccccgacgccacccaccucgggccccaguucugcaaguccugcugguucgagaacaagggccugguggagugcaacaaccacuaccugugccucaacugccugacgcugcuccugagcgucuccaaccggugccccaucugcaagaugccgcugcccaccaagcuccgccccagcgccgcccccaccgccccgcccaccggggcggccgacuccauccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6276 - RNA, 482 nt, Artificial Sequence
  mRNA product Design3 comprising derived and/or modified sequence from Lassa virus__AIT17132__Z (opt1)
gggagaaagcuuaccaugggcaacaagcaggccaaggcccccgaggcgcgcgacagcccccgggccucccugauccccgacgccacccaccucgggccccaguucugcaagagcugcugguucgagaacaagggccugguggagugcaacaaccacuaccugugccucaacugccugacccugcuccuguccgucagcaaccgcugccccaucugcaagaugccgcugcccacgaagcuccggcccuccgccacccccaccgccccgcccaccgaggcggccgacagcauccgcccgccgcccuaccggcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6277 - RNA, 482 nt, Artificial Sequence
  mRNA product Design3 comprising derived and/or modified sequence from Lassa virus__AIT17136__Z (opt1)
gggagaaagcuuaccaugggcaacaagcagaccaaggcccccgagagcaagaacuccccgcgcgccagccugauccccgacgcgaccuaccucgggccccaguucugcaaguccugcugguucgagaacaagggccugguggagugcaacaaccacuaccugugccucaacugccugacgcugcuccugagcgucuccaaccggugccccaucugcaagaugccgcugcccaccaagcuccgcagcuccgccgcccccaccgcgcccccgaccggggccgccgacagcacgaagcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6278 - RNA, 482 nt, Artificial Sequence
  mRNA product Design3 comprising derived and/or modified sequence from Lassa virus__AIT17140__Z (opt1)
gggagaaagcuuaccaugggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccgccgccccgaccgccccgcccgcgggggccguggacagcacccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6279 - RNA, 482 nt, Artificial Sequence
  mRNA product Design3 comprising derived and/or modified sequence from Lassa virus__AIT17144__Z (opt1)
gggagaaagcuuaccaugggcaacaagcaggccaagacccccgagagcaaggacuccccgcgcgccagccugauccccgacgccacccaccucgggccccaguucugcaaguccugcugguucgagaacaagggccugguggagugcaacaaccacuaccugugccucaacugccugacgcugcuccugggggucagcaaccggugccccaucugcaagaugccgcugcccaccaagcuccgcuccagcguggcccccaccgcgcccccgaccggcgccguggacuccauccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6280 - RNA, 482 nt, Artificial Sequence
  mRNA product Design3 comprising derived and/or modified sequence from Lassa virus__AIT17152__Z (opt1)
gggagaaagcuuaccaugggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccaccgcccccacggccccgcccgccggggccgcggacaacacccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6281 - RNA, 482 nt, Artificial Sequence
  mRNA product Design3 comprising derived and/or modified sequence from Lassa virus__AIT17162__Z (opt1)
gggagaaagcuuaccaugggcaacaagcaggccaaggccagcgaguccaaggacagcccccgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccccugccgacgaagcuccgccccuccgugacccccaccgcgcccccgacccggacggccgacaacacccgcccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6282 - RNA, 482 nt, Artificial Sequence
  mRNA product Design3 comprising derived and/or modified sequence from Lassa virus__AIT17166__Z (opt1)
gggagaaagcuuaccaugggcaacaagcaggccaaggcccccgaggcgaaggacagcccgcgcgccucccugauccccgacgccacccaccucgggccccaguucugcaagagcugcugguucgagaccaagggccugguggagugcaacaaccacuaccugugccucaacugccugacgcugcuccuguccgucagcaaccggugccccaucugcaagaugccgcugcccaccaagcuccgccccuccgccacccccaccgccccgcccacggaggcggccgacagcaucgggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6283 - RNA, 482 nt, Artificial Sequence
  mRNA product Design3 comprising derived and/or modified sequence from Lassa virus__AIT17170__Z (opt1)
gggagaaagcuuaccaugggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccggugccccaucugcaagaugccgcugcccacgaagcuccgccccagcgccgcccccaccgccccgcccgccggggcggccgacuccauccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6284 - RNA, 482 nt, Artificial Sequence
  mRNA product Design3 comprising derived and/or modified sequence from Lassa virus__AIT17174__Z (opt1)
gggagaaagcuuaccaugggcaacaagcagaccaaggcccccgaggccaaggggagcccgcgcgcgucccugauccccgacgccacccaccucggcccccaguucugcaagagcugcugguucgagaacaaggggcugguggagugcaacaaccacuaccugugccucaacugccugacgcugcuccuguccgucagcucccggugccccaucugcaagaugccgcugcccaccaagcuccgccccagcgccgugcccaccgccccgcccaccaaggccgaggacaacacgcggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6285 - RNA, 482 nt, Artificial Sequence
  mRNA product Design3 comprising derived and/or modified sequence from Lassa virus__AIT17178__Z (opt1)
gggagaaagcuuaccaugggcaacaagcaggccaaggccagcgaggcgaaggacagcccccgcgccucccugaucccggacgccacccaccucgggccccaguucugcaaguccugcugguucgagaacaagggccugguggagugcaacaaccacuaccugugccucaacugccugagccugcuccuguccgucagcucccggugccccaucugcaagaugccccugccgacccgccuccggcccagcacggcccccaccgcgcccccggcccgcgccggggacaacaucaagcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6286 - RNA, 482 nt, Artificial Sequence
  mRNA product Design3 comprising derived and/or modified sequence from Lassa virus__AIT17182__Z (opt1)
gggagaaagcuuaccaugggcaacaagcaggccaaggugcccgagguccgcgacagcccccgggccucccugauccccgacgcgacccaccucgggccccaguucugcaagagcugcugguucgagaacaagggccugguggagugcaacaaccacuaccugugccucaacugccugacccugcuccuguccgugagcucccgcugccccaucugcaagaugccgcugcccacgaagcuccggcccagcgccacccccaccgccccgcccgccggggccggcgacgggacccgcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6287 - RNA, 482 nt, Artificial Sequence
  mRNA product Design3 comprising derived and/or modified sequence from Lassa virus__AIT17186__Z (opt1)
gggagaaagcuuaccaugggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccguggcccccaccgccccgcccgccggggccgcggacaacacgcggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6288 - RNA, 482 nt, Artificial Sequence
  mRNA product Design3 comprising derived and/or modified sequence from Lassa virus__AIT17194__Z (opt1)
gggagaaagcuuaccaugggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccguggccccgaccgccccgcccgccgggguggucgacagcacccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6289 - RNA, 482 nt, Artificial Sequence
  mRNA product Design3 comprising derived and/or modified sequence from Lassa virus__AIT17198__Z (opt1)
gggagaaagcuuaccaugggcaacaagcaggccaaggugcccgagagcaaggacuccccgcgcgccagccugauccccgacgcgacccaccucgggccccaguucugcaaguccugcugguucgagaaccgcggccuggucgagugcaacaaccacuaccugugccucaacugccugacccugcuccugagcguguccaaccgcugccccaucugcaagaugccgcugcccacgaagcuccggcccagcaccgcccccaccgccccgcccaccggggccgccgacuccacgcggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6290 - RNA, 482 nt, Artificial Sequence
  mRNA product Design3 comprising derived and/or modified sequence from Lassa virus__AIT17202__Z (opt1)
gggagaaagcuuaccaugggcaacaagcaggccaagacccccgagagcaaggacuccccgcgcgccagccugauccccgacgcgacccaccucgggccccaguucugcaaguccugcugguucgagaacaagggccugguggagugcaacaaccacuaccugugccucaacugccugacgcugcuccugagcgucuccaaccgcugccccaucugcaagaugccgcugcccacccgccuccggcccagcgccgcccccaccgccccgcccuccggggccgcggacagcacccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6291 - RNA, 482 nt, Artificial Sequence
  mRNA product Design3 comprising derived and/or modified sequence from Lassa virus__AIT17206__Z (opt1)
gggagaaagcuuaccaugggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcuaccggugccccaucugcaagaugccgcugcccacgaagcuccgccccuccgccacccccaccgccccgcccaccgaggcggccgacagcauccggcccccgcccuaccgccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6292 - RNA, 482 nt, Artificial Sequence
  mRNA product Design3 comprising derived and/or modified sequence from Lassa virus__AIT17214__Z (opt1)
gggagaaagcuuaccaugggcaacaagcaggccaaggcccccgaggugaaggacagcccgcgcgcgucccugauccccgacgccacccaccucgggccccaguucugcaagagcugcugguucgagaacaagggccuggucgagugcaacaaccacuaccugugccucaacugccugacccugcuccuguccgugagcaaccggugccccaucugcaagaugccgcugcccacgaagcuccgccccuccgccgcccccaccgccccgcccaccgggaccgcggacagcauccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6293 - RNA, 482 nt, Artificial Sequence
  mRNA product Design3 comprising derived and/or modified sequence from Lassa virus__AIT17222__Z (opt1)
gggagaaagcuuaccaugggcaacaagcaggccaagacccccgagaccaaggacagcccccgcgccucccugauccccgacgcgacgcaccucgggccccaguucugcaagagcugcugguucgagaacaagggccugguggagugcaacucccacuaccugugccucaacugccugacccugcuccugagcgucuccagccggugccccaucugcaagaugccgcugcccacccgccuccggcccuccaccgcccccacggccccgcccgccggggugggcgacagcaccuccccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6294 - RNA, 482 nt, Artificial Sequence
  mRNA product Design3 comprising derived and/or modified sequence from Lassa virus__AIT17226__Z (opt1)
gggagaaagcuuaccaugggcaacaagcaggccaagacccccgaggccaaggacagcccccgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccacccccaccgccccgcccgccggggcggccgacagcaucggcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6295 - RNA, 479 nt, Artificial Sequence
  mRNA product Design3 comprising derived and/or modified sequence from Lassa virus__AIT17230__Z (opt1)
gggagaaagcuuaccaugggcaacaagcaggccaaggccagcgacaagaacagcccccgcgcgucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcgccacccccaccgcgcccccgaccggggccgccgacuccauccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6296 - RNA, 482 nt, Artificial Sequence
  mRNA product Design3 comprising derived and/or modified sequence from Lassa virus__AIT17234__Z (opt1)
gggagaaagcuuaccaugggcaacaagcaggccaaggccagcgaggagaagaacagcccccgcgcgucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcgccacccccaccgcgcccccgaccggggccgccgacuccauccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6297 - RNA, 482 nt, Artificial Sequence
  mRNA product Design3 comprising derived and/or modified sequence from Lassa virus__AIT17238__Z (opt1)
gggagaaagcuuaccaugggcaacaagcagaccaaggcccccgaggccaaggggagcccgcgcgcgucccugauccccgacgccacccaccucggcccccaguucugcaagagcugcugguucgagaacaaggggcugguggagugcaacaaccacuaccugugccucaacugccugacgcugcuccuguccgucagcaaccggugccccaucugcaagaugccgcugcccaccaagcuccgccccuccgccacccccaccgccccgcccacggaggccgcggacagcauccggcccccgcccuaccgccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6298 - RNA, 482 nt, Artificial Sequence
  mRNA product Design3 comprising derived and/or modified sequence from Lassa virus__AIT17242__Z (opt1)
gggagaaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgcgccuccggcccagcgccgcccccaccgccccgcccaccggggcgaccgacuccacgcggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6299 - RNA, 482 nt, Artificial Sequence
  mRNA product Design3 comprising derived and/or modified sequence from Lassa virus__AIT17248__Z (opt1)
gggagaaagcuuaccaugggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagacgccgcugcccacccggcuccgccccuccgccacccccaccgccccgcccgccggcgcgggggacaacacgcggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6300 - RNA, 482 nt, Artificial Sequence
  mRNA product Design3 comprising derived and/or modified sequence from Lassa virus__AIT17252__Z (opt1)
gggagaaagcuuaccaugggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccgcugcccacgaagcuccgccccuccaccgcccccaccgccccgcccgcgggggccgccgacagcacccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6301 - RNA, 482 nt, Artificial Sequence
  mRNA product Design3 comprising derived and/or modified sequence from Lassa virus__AIT17256__Z (opt1)
gggagaaagcuuaccaugggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgugggggcggccgacaacacccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6302 - RNA, 482 nt, Artificial Sequence
  mRNA product Design3 comprising derived and/or modified sequence from Lassa virus__AIT17260__Z (opt1)
gggagaaagcuuaccaugggcaacaagcaggccaaggcccccgagcugaaggacagcccgcgcgcgucccucauccccgacgccacccaccuggggccccaguucugcaagagcugcugguucgagaacaagggccugguggagugcaacaaccacuaccucugccugaacugccugacccuccugcuguccgucagcaaccggugccccaucugcaagaugccgcuccccacgaagcugcgccccuccgccgcccccaccgccccgcccgcgggggccguggacagcacccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6303 - RNA, 482 nt, Artificial Sequence
  mRNA product Design3 comprising derived and/or modified sequence from Lassa virus__AIT17268__Z (opt1)
gggagaaagcuuaccaugggcaacaagcagaccaaggcccccgaggugaaggggagcccccgcgccucccugauccccgacgcgacccaccucggcccccaguucugcaagagcugcugguucgagaacaaggggcuggucgagugcaacaaccacuaccugugccucaacugccugacgcugcuccuguccgugagcaaccggugccccaucugcaagaugccgcugcccaccaagcucaagcccuccaccacccccacggccccgcccaccggcgccgccgacagcauccgcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6304 - RNA, 482 nt, Artificial Sequence
  mRNA product Design3 comprising derived and/or modified sequence from Lassa virus__AIT17272__Z (opt1)
gggagaaagcuuaccaugggcaacaagcaggucaagaccagcgaggcccgcgacagcccccgggccucccugaucccggacgccaccgaccucgggccccaguucugcaaguccugcugguucgagaacaagggccugguggagugcaacaaccacuaccugugccucaacugccugacgcugcuccugagcguguccaaccgcugccccaucugcaagaugccccugccgacccggcuccgccccagcgccaaccccaccgcgcccccggccgagaccggggacuccacgcggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6305 - RNA, 482 nt, Artificial Sequence
  mRNA product Design3 comprising derived and/or modified sequence from Lassa virus__AIT17278__Z (opt1)
gggagaaagcuuaccaugggcagcaagcagaccaagacccccgaggugaaggacuccccgcgcgccagccugauccccgacgccacgcaccucgggccccaguucugcaaguccugcugguucgagaacaagggccuggucgagugcaacaaccacuaccugugccucaacugccugacccugcuccugagcguguccaaccgcugccccaucugcaagaugccgcugcccaccaagcuccgccccagcgcggcccccaccgccccgcccgcccgggccgcggacgacacgcggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6306 - RNA, 482 nt, Artificial Sequence
  mRNA product Design3 comprising derived and/or modified sequence from Lassa virus__AIT17282__Z (opt1)
gggagaaagcuuaccaugggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccgccgccccgaccgccccgcccgcgggggccguggacagcauccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6307 - RNA, 482 nt, Artificial Sequence
  mRNA product Design3 comprising derived and/or modified sequence from Lassa virus__AIT17286__Z (opt1)
gggagaaagcuuaccaugggcaacaagcagaccaaggcccccgaggugaaggacagcccgcgcgccucccugauccccgacgcgacccaccucgggccccaguucugcaagagcugcugguucgagaacaagggccuggucgagugcaacaaccacuaccugugccucaacugccugacgcugcuccuguccgugagcaaccggugccccaucugcaagaugccgcugcccaccaagcuccgccccuccaccgcccccaccgccccgcccgccgggacgauggacagcacccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6308 - RNA, 482 nt, Artificial Sequence
  mRNA product Design3 comprising derived and/or modified sequence from Lassa virus__AIT17290__Z (opt1)
gggagaaagcuuaccaugggcaacaagcaggcccgcgcccccgaggcgaaggacagcccgcgggccucccugauccccgacgccacccaccucgggccccaguucugcaagagcugcugguucgagaacaagggccugguggagugcaacaaccacuaccugugccucaacugccugacccugcuccuguccgucagcucccgcugccccaucugcaagaugccgcugcccacgcggcuccgccccagcgccauccccaccgccccgcccgcggggaccggcgacuccagccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6309 - RNA, 482 nt, Artificial Sequence
  mRNA product Design3 comprising derived and/or modified sequence from Lassa virus__AIT17296__Z (opt1)
gggagaaagcuuaccaugggcaacaagcaggccaagacccccgagaucaaggacagcccgcgcgccucccugauccccgacgcgacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgccggggcggccgacaucacccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6310 - RNA, 482 nt, Artificial Sequence
  mRNA product Design3 comprising derived and/or modified sequence from Lassa virus__AIT17300__Z (opt1)
gggagaaagcuuaccaugggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagaugccgcugcccacgcggcuccgccccuccaccgcccccaccgccccgcccgccggcgcgggggacaacacccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6311 - RNA, 482 nt, Artificial Sequence
  mRNA product Design3 comprising derived and/or modified sequence from Lassa virus__AIT17312__Z (opt1)
gggagaaagcuuaccaugggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccgccgcccccaccgccccgcccgugggggccgcggacagcacgcggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6312 - RNA, 482 nt, Artificial Sequence
  mRNA product Design3 comprising derived and/or modified sequence from Lassa virus__AIT17316__Z (opt1)
gggagaaagcuuaccaugggcaacaagcaggccaaggcccccgaggcgcgcaacagcccccgggccucccugauccccgacgccacccaccucgggccccaguucugcaagagcugcugguucgagaaccgcggccugguggagugcaacaaccacuaccugugccucaacugccugacccugcuccuguccgucagcucccggugccccaucugcaagaugccgcugcccacgcgccuccggcccagcgccgcccccaccgcgccgcccgccggggccggcgacaacacccgcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6313 - RNA, 482 nt, Artificial Sequence
  mRNA product Design3 comprising derived and/or modified sequence from Lassa virus__AIT17320__Z (opt1)
gggagaaagcuuaccaugggcaacaagcaggccaaggcccccgaggcgcgcaacagcccgcgggccucccugauccccgacgccacccaccucgggccccaguucugcaagagcugcugguucgagaacaagggccugguggagugcaacaaccacuaccugugccucaacugccugacccugcuccugggggucuccagccgcugccccaucugcaagaugccgcugcccacgcggcuccgccccuccgccgcccccaccgcgccgcuggccgaggccggcgacaacacccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6314 - RNA, 482 nt, Artificial Sequence
  mRNA product Design3 comprising derived and/or modified sequence from Lassa virus__AIT17326__Z (opt1)
gggagaaagcuuaccaugggcaacaagcagagcaaggcccccgagucccgcgacagcccgcgggccucccugauccccgacgcgacccaccucgggccccaguucugcaagagcugcugguucgagaacaagggccugguggagugcaacaaccacuaccugugccucaacugccugacccugcuccuguccgucagcaaccgcugccccaucugcaagaugccgcugcccacgaagcuccggcccuccgccacccccaccgccccgcccacccgcgccgccgacagcauccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6315 - RNA, 482 nt, Artificial Sequence
  mRNA product Design3 comprising derived and/or modified sequence from Lassa virus__AIT17330__Z (opt1)
gggagaaagcuuaccaugggcaacaagcaggccaaggcccuggagagcaagaacagcccccgcgcgucccucauccccgacgccaccuaccuggggccccaguucugcaaguccugcugguucgagaacaagggccugguggagugcaacaaccacuaccucugccugaacugccugacccuccugcugagcgucuccaaccggugccccaucugcaagaugccccucccgacgaagcugcgcagcuccgccgcccccaccgccccgcccaccggggcggccgacggcaccaagcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6316 - RNA, 482 nt, Artificial Sequence
  mRNA product Design3 comprising derived and/or modified sequence from Lassa virus__AIT17342__Z (opt1)
gggagaaagcuuaccaugggcaacaagcaggccaaggccagcgaggcgaaggacagcccccgcgccucccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcaccgcccccaccgcgccccagaccggggccgccgacuccauccggccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6317 - RNA, 482 nt, Artificial Sequence
  mRNA product Design3 comprising derived and/or modified sequence from Lassa virus__AIT17346__Z (opt1)
gggagaaagcuuaccaugggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgugggggcggccgacagcacccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6318 - RNA, 482 nt, Artificial Sequence
  mRNA product Design3 comprising derived and/or modified sequence from Lassa virus__AIT17362__Z (opt1)
gggagaaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccgcugcccacgaagcuccgccccagcgccgcccccaccgccccgcccgcgggggccgccgacuccauccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6319 - RNA, 482 nt, Artificial Sequence
  mRNA product Design3 comprising derived and/or modified sequence from Lassa virus__AIT17366__Z (opt1)
gggagaaagcuuaccaugggcaacaagcagaccaagacccccgaggugaaggacagcccccgcgccucccugauccccgacgccacgcaccucgggccccaguucugcaagagcugcugguucgagaacaagggccuggucgagugcaacaaccacuaccugugccucaacugccugacccugcuccuguccgugagcaaccggugccccaucugcaagaugccgcugcccaccaagcuccgccccuccgcggcccccaccgccccgcccgcccgggccgcggacgacacgcgcccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6320 - RNA, 482 nt, Artificial Sequence
  mRNA product Design3 comprising derived and/or modified sequence from Lassa virus__AIT17376__Z (opt1)
gggagaaagcuuaccaugggcaacaagcaggccaaggcccccgagagcaaggacuccccgcgcgcgagccugauccccgacgccaccuaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgaagcuccgcagcuccguggcccccaccgcgcccccgacccgggccgccgacagcacccggcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6321 - RNA, 482 nt, Artificial Sequence
  mRNA product Design3 comprising derived and/or modified sequence from Lassa virus__AIT17382__Z (opt1)
gggagaaagcuuaccaugggcaacaagcagaccaagaccagcgaggugaaggacagcccccgcgccucccugauccccgacgccacgcaccucgggccccaguucugcaaguccugcugguucgagaacaagggccuggucgagugcaacaaccacuaccugugccucaacugccugacccugcuccugagcguguccaaccggugccccaucugcaagaugccccugccgaccaagcuccgccccagcgcggcccccaccgcgcccccggcccgggccgccgacgacacgcgcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6322 - RNA, 482 nt, Artificial Sequence
  mRNA product Design3 comprising derived and/or modified sequence from Lassa virus__AIT17386__Z (opt1)
gggagaaagcuuaccaugggcaacaagcaggccaagacccccgaggcccgcgacagcccccgggcgucccugauccccgacgccacccaccucgggccccaguucugcaagagcugcugguucgagaacaagggccugguggagugcaacaaccacuaccugugccucaacugccugacgcugcuccuguccgucagcucccgcugccccaucugcaagaugccgcugcccaccaagcuccggcccagcgccacccccaccgccccgcccgccggggcgggcgacgggacgcgcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6323 - RNA, 482 nt, Artificial Sequence
  mRNA product Design3 comprising derived and/or modified sequence from Lassa virus__AIT17396__Z (opt1)
gggagaaagcuuaccaugggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagaugccgcugcccacgcggcuccgccccuccgccgcccccaccgccccgcccgcggaggccggcgacaacacccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6324 - RNA, 482 nt, Artificial Sequence
  mRNA product Design3 comprising derived and/or modified sequence from Lassa virus__AIT17402__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggagaccauccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6325 - RNA, 482 nt, Artificial Sequence
  mRNA product Design3 comprising derived and/or modified sequence from Lassa virus__AIT17406__Z (opt1)
gggagaaagcuuaccaugggcaaccgccaggccaagagcuccaagguggacgagcaccagcgggcccaccugguccccgacgcgagccaccucgggccccaguucugcaaguccugcugguucgagaacaagggccugguggagugcaacaaccacuaccugugccucaacugccugagccugcuccuguccgugagcucccgcugccccaucugcaagaugccccugcccaccaagcucaaggccgccgcccagccgagcgcccccuccaccgaggcgguccagaacacggccccgccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6326 - RNA, 482 nt, Artificial Sequence
  mRNA product Design3 comprising derived and/or modified sequence from Lassa virus__AIT17410__Z (opt1)
gggagaaagcuuaccaugggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6327 - RNA, 482 nt, Artificial Sequence
  mRNA product Design3 comprising derived and/or modified sequence from Lassa virus__AIT17418__Z (opt1)
gggagaaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgagaccauccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6328 - RNA, 482 nt, Artificial Sequence
  mRNA product Design3 comprising derived and/or modified sequence from Lassa virus__AIT17422__Z (opt1)
gggagaaagcuuaccaugggcaaccgccaggccaagagcgccaagguggacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacccagccguccgcccccagcacggaggcgacccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6329 - RNA, 482 nt, Artificial Sequence
  mRNA product Design3 comprising derived and/or modified sequence from Lassa virus__AIT17426__Z (opt1)
gggagaaagcuuaccaugggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccacgcagccguccgcccccagcaccgaggccacccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6330 - RNA, 482 nt, Artificial Sequence
  mRNA product Design3 comprising derived and/or modified sequence from Lassa virus__AIT17432__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccaucccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6331 - RNA, 482 nt, Artificial Sequence
  mRNA product Design3 comprising derived and/or modified sequence from Lassa virus__AIT17436__Z (opt1)
gggagaaagcuuaccaugggcaacaagcaggccaagagcaccaaggccgacgagcaccagcgcgcgcaccuggugcccgacgccucccaccucgggccgcaguucugcaagagcugcugguucgagaaccggggccuggucgagugcaacaaccacuaccugugccucaacugccugucccugcuccugagcguguccagccgcugccccaucugcaagaugccccugcccaccaagcucaaggccgccacgcagccguccgcccccagcaccgaggcgacccggaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6332 - RNA, 482 nt, Artificial Sequence
  mRNA product Design3 comprising derived and/or modified sequence from Lassa virus__AIT17444__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccgccgcccagccguccgcccccagcacggaggcggcccagaacaccgccccgccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6333 - RNA, 482 nt, Artificial Sequence
  mRNA product Design3 comprising derived and/or modified sequence from Lassa virus__AIT17448__Z (opt1)
gggagaaagcuuaccaugggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccacggcccagccguccgcccccagcgccgaggcgauccagaacaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6334 - RNA, 482 nt, Artificial Sequence
  mRNA product Design3 comprising derived and/or modified sequence from Lassa virus__AIT17452__Z (opt1)
gggagaaagcuuaccaugggcaaccgccaggccaagagcacccggguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccacccggcuccgcgccgccguccagccguccgcccccagcacggagaccacccaggacaccacgcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6335 - RNA, 482 nt, Artificial Sequence
  mRNA product Design3 comprising derived and/or modified sequence from Lassa virus__AIT17456__Z (opt1)
gggagaaagcuuaccaugggcaaccgccaggccaagagcaccgaggugaacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccgugcccccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6336 - RNA, 482 nt, Artificial Sequence
  mRNA product Design3 comprising derived and/or modified sequence from Lassa virus__AIT17460__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagcccuccgccccgcccacggaggcgacccagaacaccacgccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6337 - RNA, 482 nt, Artificial Sequence
  mRNA product Design3 comprising derived and/or modified sequence from Lassa virus__AIT17468__Z (opt1)
gggagaaagcuuaccaugggcaaccgccaggccaagcagaccaagguggacgagcaccagcgggcccaccugguccccgacgcgagccaccucgggccccaguucugcaaguccugcugguucgagaaccgcggccugguggagugcaacaaccacuaccugugccucaacugccugagccugcuccuguccaucagcucccggugccccaucugcaagaugccccugcccaccaagcucaaggccgccgcccagccgagcgcccccuccacggaggcgacccaggacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6338 - RNA, 482 nt, Artificial Sequence
  mRNA product Design3 comprising derived and/or modified sequence from Lassa virus__AIT17472__Z (opt1)
gggagaaagcuuaccaugggcaacaagcagaccaagagcaccaaggccgacgagcaccagcgcgcccaccuggugcccgacgcgucccaccucgggccgcaguucugcaagagcugcugguucgagaaccggggccuggucgagugcaacaaccacuaccugugccucaacugccugucccugcuccugagcguguccagccgcugccccaucugcaagaugccccugcccacgcggcucaaggccgccgcccagccguccgcccccagcaccgaggcgacccaggacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6339 - RNA, 482 nt, Artificial Sequence
  mRNA product Design3 comprising derived and/or modified sequence from Lassa virus__AIT17476__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcgcggaggccauccagaacacgaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6340 - RNA, 482 nt, Artificial Sequence
  mRNA product Design3 comprising derived and/or modified sequence from Lassa virus__AIT17480__Z (opt1)
gggagaaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggucauccaguccaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6341 - RNA, 482 nt, Artificial Sequence
  mRNA product Design3 comprising derived and/or modified sequence from Lassa virus__AIT17484__Z (opt1)
gggagaaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggagauccagaacaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6342 - RNA, 482 nt, Artificial Sequence
  mRNA product Design3 comprising derived and/or modified sequence from Lassa virus__AIT17488__Z (opt1)
gggagaaagcuuaccaugggcaaccgccaggccaagcccaccaagguggacgagcaccagcgggcccaccuggucccggacgccagccaccucgggccccaguucugcaaguccugcugguucgagaacaagggccugguggagugcaacaaccacuaccugugccucaacugccugagccugcuccuguccgugagcucccgcugccccaucugcaagaugccccugccgaccaagcucaaggccgccgcccagcccagcgcccccuccacggaggcggcccagaacaccgcgcccccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6343 - RNA, 482 nt, Artificial Sequence
  mRNA product Design3 comprising derived and/or modified sequence from Lassa virus__AIT17496__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccacccgccucaaggccgccacgcagccguccgcccccagcaccgaggccacccagaccacgaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6344 - RNA, 482 nt, Artificial Sequence
  mRNA product Design3 comprising derived and/or modified sequence from Lassa virus__AIT17500__Z (opt1)
gggagaaagcuuaccaugggcaaccgccagaccaagagcaccaagguggacgagcaccagcgggcccaccugguccccgacgccucccaccucgggccccaguucugcaagagcugcugguucgagaacaagggccugguggagugcaacaaccacuaccugugccucaacugccugucccugcuccugagcguguccagccgcugccccaucugcaagaugccccugcccacgaagcucaagaccgcggcccagccguccgccccgcccaccgaggccgcccggaccacggcgcccccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6345 - RNA, 482 nt, Artificial Sequence
  mRNA product Design3 comprising derived and/or modified sequence from Lassa virus__AIT17508__Z (opt1)
gggagaaagcuuaccaugggcaaccgccagaccaagagcaccaagguggacgagcaccagcgggcccaccugguccccgacgccucccaccucgggccgcaguucugcaagagcugcugguucgagaacaagggccugguggagugcaacaaccacuaccugugccucaacugccugucccugcuccugagcguguccagccgcugccccaucugcaagaugccccugcccacgaagcucaaggcggccgcccagccguccgcccccagcaccgaggccacccagaacaccgcgcccccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6346 - RNA, 482 nt, Artificial Sequence
  mRNA product Design3 comprising derived and/or modified sequence from Lassa virus__AIT17512__Z (opt1)
gggagaaagcuuaccaugggcaaccgccaggccaagagcaccaagguguacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccacccgccucaaggccgccacgcagccguccgcccccagcaccgaggccacccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6347 - RNA, 482 nt, Artificial Sequence
  mRNA product Design3 comprising derived and/or modified sequence from Lassa virus__AIT17516__Z (opt1)
gggagaaagcuuaccaugggcaaccgccaggccaagagcaccaagguggacgagcaccagcgggcccaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaagacggccacccagccguccgcgccccugaccgaggccacccagaacacgaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6348 - RNA, 482 nt, Artificial Sequence
  mRNA product Design3 comprising derived and/or modified sequence from Lassa virus__AIT17520__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccaaccgcugccccaucugcaagaugccccugcccaccaagcucaaggccgccgcccagccgagcgcccccuccacggaggcgacccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6349 - RNA, 482 nt, Artificial Sequence
  mRNA product Design3 comprising derived and/or modified sequence from Lassa virus__AIT17526__Z (opt1)
gggagaaagcuuaccaugggcaaccgccaggccaagagcgccaaggugaccgagcaccagcgggcccaccugguccccgacgccucccaccucgggccgcaguucugcaagagcugcugguucgagaacaagggccugguggagugcaacaaccacuaccugugccucaacugccugucccugcuccugagcguguccagccgcugccccaucugcaagaugccccugcccacccggcucaaggccgccacccagccguccgcccccagcgcggaggcgccccaguccaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6350 - RNA, 482 nt, Artificial Sequence
  mRNA product Design3 comprising derived and/or modified sequence from Lassa virus__AIT17536__Z (opt1)
gggagaaagcuuaccaugggcaaccgccagacccggcccaccgaggccacggagcagagccgcgcccaccuggugccggacgccucccaccucgggccccaguucugcaagagcugcugguucgagaacaagggccuggucgagugcaacaaccacuaccugugccucaacugccugucccugcuccugagcguguccagccggugccccaucugcaagaugccccugccgacccgccucaaggccuccgcccagcccagcgccccgcccaccgaggcgccccagaacaaggcgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6351 - RNA, 482 nt, Artificial Sequence
  mRNA product Design3 comprising derived and/or modified sequence from Lassa virus__AIT17542__Z (opt1)
gggagaaagcuuaccaugggcaaccgccaggucaagagcaccaagguggacgagcaccagcgggcccaccugauccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucgaggcggccgcccagccguccgcccccagcacggaggccacccaggacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6352 - RNA, 482 nt, Artificial Sequence
  mRNA product Design3 comprising derived and/or modified sequence from Lassa virus__AIT17546__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccgcccagccguccgcccccagcacggagaccauccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6353 - RNA, 482 nt, Artificial Sequence
  mRNA product Design3 comprising derived and/or modified sequence from Lassa virus__AIT17550__Z (opt1)
gggagaaagcuuaccaugggcaaccgccaggccaagcagaccaagguggacgagcaccagcgggcccaccugguccccgacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugcccaccaagcucaaggccgccgcccagccgagcgcccccuccacggagaucacccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6354 - RNA, 482 nt, Artificial Sequence
  mRNA product Design3 comprising derived and/or modified sequence from Lassa virus__AIT17554__Z (opt1)
gggagaaagcuuaccaugggcaaccgccaggccaagagcaccaaggccgacgagcaccagcgggcgcaccuggugcccgacgccucccaccucgggccccaguucugcaagagcugcugguucgagaaccgcggccuggucgagugcaacaaccacuaccugugccucaacugccugucccugcuccugagcguguccaaccggugccccaucugcaagaugccccugcccacccgccucaaggccgccgcccagccgagcgcgcccuccacggaggccacccaggacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6355 - RNA, 482 nt, Artificial Sequence
  mRNA product Design3 comprising derived and/or modified sequence from Lassa virus__AIT17558__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccacccgccucaaggccgccgcccagccguccgcccccagcacggaggcgauccgguccaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6356 - RNA, 482 nt, Artificial Sequence
  mRNA product Design3 comprising derived and/or modified sequence from Lassa virus__AIT17570__Z (opt1)
gggagaaagcuuaccaugggcaaccgccaggccaagagcgccaaggugaacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcgcccagcaccgaggccacgcagaacaucaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6357 - RNA, 482 nt, Artificial Sequence
  mRNA product Design3 comprising derived and/or modified sequence from Lassa virus__AIT17578__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcuccgggccgccgcccagccguccgcccccagcacggaguccgcgcagaacaccgccccgccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6358 - RNA, 482 nt, Artificial Sequence
  mRNA product Design3 comprising derived and/or modified sequence from Lassa virus__AIT17586__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccacccggcucaaggccgccgcccagccguccgcccccagcacggaggucacccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6359 - RNA, 482 nt, Artificial Sequence
  mRNA product Design3 comprising derived and/or modified sequence from Lassa virus__AIT17590__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucgaggccacgacccagccguccgcccccagcaccgaggagacccaguccacgaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6360 - RNA, 482 nt, Artificial Sequence
  mRNA product Design3 comprising derived and/or modified sequence from Lassa virus__AIT17602__Z (opt1)
gggagaaagcuuaccaugggcaacaagcaggccaagagcaccaagguggacgaguaccagcgcgcccaccugguccccgacgcgucccaccucgggccccaguucugcaagagcugcugguucgagaaccggggccugguggagugcaacaaccacuaccugugccucaacugccugucccugcuccugagcguguccaaccgcugccccaucugcaagaugccccugcccacccggcucaaggccgccgcccagcccagcgccccgcccacggaggcgacccagaacaccacgccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6361 - RNA, 482 nt, Artificial Sequence
  mRNA product Design3 comprising derived and/or modified sequence from Lassa virus__AIT17610__Z (opt1)
gggagaaagcuuaccaugggcaaccgccaggccaagcccaccaagguggacgagcaccagcgggcccagcuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgaccaagcucaaggccgccacgcagcccagcgcccccuccaccgaggccacccagaacagcacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6362 - RNA, 482 nt, Artificial Sequence
  mRNA product Design3 comprising derived and/or modified sequence from Lassa virus__AIT17614__Z (opt1)
gggagaaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggccacccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6363 - RNA, 482 nt, Artificial Sequence
  mRNA product Design3 comprising derived and/or modified sequence from Lassa virus__AIT17618__Z (opt1)
gggagaaagcuuaccaugggcaaccgccaggccaagagcaccgagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccaaccggugccccaucugcaagaugccccugcccaccaagcucaaggccgccacgcagccgagcgcccccuccaccgaggccacccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6364 - RNA, 482 nt, Artificial Sequence
  mRNA product Design3 comprising derived and/or modified sequence from Lassa virus__AIT17622__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccaucccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6365 - RNA, 482 nt, Artificial Sequence
  mRNA product Design3 comprising derived and/or modified sequence from Lassa virus__AIT17628__Z (opt1)
gggagaaagcuuaccaugggcaacaagcaggccaagagcaccaagaucgacgagcaccagcgcgcccaccuggugcccgacgcgucccaccucgggccgcaguucugcaagagcugcugguucgagaaccggggccuggucgagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6366 - RNA, 482 nt, Artificial Sequence
  mRNA product Design3 comprising derived and/or modified sequence from Lassa virus__AIT17632__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcuccgggccacggcccagccguccgcccccagcaccgaggccauccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6367 - RNA, 482 nt, Artificial Sequence
  mRNA product Design3 comprising derived and/or modified sequence from Lassa virus__AIT17636__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcaucgagacgauccagaacaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6368 - RNA, 482 nt, Artificial Sequence
  mRNA product Design3 comprising derived and/or modified sequence from Lassa virus__AIT17640__Z (opt1)
gggagaaagcuuaccaugggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccgccgcccagccguccgcccccagcacggaggcgacccaggacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6369 - RNA, 482 nt, Artificial Sequence
  mRNA product Design3 comprising derived and/or modified sequence from Lassa virus__AIT17648__Z (opt1)
gggagaaagcuuaccaugggcaaccgccaggccaagagcaccaagguggacgagcaccagcgggcccaccugguccccgacgcgucccaccucgggccgcaguucugcaagagcugcugguucgagaacaagggccugguggagugcaacaaccacuaccugugccucaacugccugucccugcuccugagcguguccagccgcugccccaucugcaagaugccccugcccaccaagcucaaggccacgguccagccguccgcccccagcaccgaggccgcccaguccaccgcgcccccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6370 - RNA, 482 nt, Artificial Sequence
  mRNA product Design3 comprising derived and/or modified sequence from Lassa virus__AIT17652__Z (opt1)
gggagaaagcuuaccaugggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccgccgcccagccguccgcccccagcgcggaggccauccagaagacgaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6371 - RNA, 482 nt, Artificial Sequence
  mRNA product Design3 comprising derived and/or modified sequence from Lassa virus__AIT17656__Z (opt1)
gggagaaagcuuaccaugggcaaccgccaggccaagagcaccaagguggacgaccaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcggcccaggacaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6372 - RNA, 482 nt, Artificial Sequence
  mRNA product Design3 comprising derived and/or modified sequence from Lassa virus__AIT17660__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccaaccggugccccaucugcaagaugccccugcccaccaagcucaaggccgccgcccagccgagcgcccccuccacggaggcgauccagaacaccaccccgccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6373 - RNA, 482 nt, Artificial Sequence
  mRNA product Design3 comprising derived and/or modified sequence from Lassa virus__AIT17664__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaacaagggccugguggagugcaacaaccacuaccugugccucaacugccugucccugcuccugagcguguccagccggugccccaucugcaagaugccccugcccaccaagcucaaggccgccgcccagccguccgcccccagcacggaggcggcccagaacaccgccccgccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6374 - RNA, 482 nt, Artificial Sequence
  mRNA product Design3 comprising derived and/or modified sequence from Lassa virus__AIT17668__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaagacgaccgcccagccguccgccccgcccaccgaggccgccaagaacaccgcgcccccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6375 - RNA, 482 nt, Artificial Sequence
  mRNA product Design3 comprising derived and/or modified sequence from Lassa virus__AIT17676__Z (opt1)
gggagaaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6376 - RNA, 482 nt, Artificial Sequence
  mRNA product Design3 comprising derived and/or modified sequence from Lassa virus__AIT17680__Z (opt1)
gggagaaagcuuaccaugggcaaccgccaggccaagagcaccaagaucgacgagcaccagcgggcccaccuggugcccgacgcgucccaccucgggccccaguucugcaagagcugcugguucgagaaccgcggccuggucgagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6377 - RNA, 482 nt, Artificial Sequence
  mRNA product Design3 comprising derived and/or modified sequence from Lassa virus__AIT17684__Z (opt1)
gggagaaagcuuaccaugggcaaccgccaggccaagagcgccaagguggacgagcaccagcgggcgcaccugguccccgacgccucccaccucgggccccaguucugcaagagcugcugguucgagaacaagggccugguggagugcaacaaccacuaccugugccucaacugccugucccugcuccugagcguguccugccgcugccccaucugcaagaugccccugcccaccaagcucaaggccgccacccagccgagcgcccccuccacggaggcgacccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6378 - RNA, 482 nt, Artificial Sequence
  mRNA product Design3 comprising derived and/or modified sequence from Lassa virus__AIT17692__Z (opt1)
gggagaaagcuuaccaugggcaaccgccacgccaagcccaccaagguggacgagcaccagcgggcccaccuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgaccaagcucaaggccgccgcccagcccagcgcccccuccaccgaggcgauccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6379 - RNA, 482 nt, Artificial Sequence
  mRNA product Design3 comprising derived and/or modified sequence from Lassa virus__AIT17702__Z (opt1)
gggagaaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcguuccagaacaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6380 - RNA, 482 nt, Artificial Sequence
  mRNA product Design3 comprising derived and/or modified sequence from Lassa virus__AIT17708__Z (opt1)
gggagaaagcuuaccaugggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggccauccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6381 - RNA, 482 nt, Artificial Sequence
  mRNA product Design3 comprising derived and/or modified sequence from Lassa virus__AIT17716__Z (opt1)
gggagaaagcuuaccaugggcaaccgccccgccaagagcaccaagguggacgagcaccagcgggcccaccuggucccggacgcgucccaccucgggccccaguucugcaagagcugcugguucgagaaccgcggccugguggagugcaacaaccacuaccugugccucaacugccugucccugcuccugagcguguccagccggugccccaucugcaagaugccccugccgaccaagcucaaggccgccgcccagcccuccgcccccagcacggaggcgacccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6382 - RNA, 482 nt, Artificial Sequence
  mRNA product Design3 comprising derived and/or modified sequence from Lassa virus__AIT17720__Z (opt1)
gggagaaagcuuaccaugggcaaccgccaggccaagcccaccaagguggacgagcaccagcgggcccaccuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgacccgccucaaggccgccgcccagcccagcgcccccuccacggaggagacccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6383 - RNA, 482 nt, Artificial Sequence
  mRNA product Design3 comprising derived and/or modified sequence from Lassa virus__AIT17730__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcgccccugacggaggccauccagaacaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6384 - RNA, 482 nt, Artificial Sequence
  mRNA product Design3 comprising derived and/or modified sequence from Lassa virus__AIT17734__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6385 - RNA, 482 nt, Artificial Sequence
  mRNA product Design3 comprising derived and/or modified sequence from Lassa virus__AIT17738__Z (opt1)
gggagaaagcuuaccaugggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcugccguccgcccccagcaccgaggucacccagaacaccacgcccccgccccacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6386 - RNA, 482 nt, Artificial Sequence
  mRNA product Design3 comprising derived and/or modified sequence from Lassa virus__AIT17750__Z (opt1)
gggagaaagcuuaccaugggcaaccgccaggccaagagcgccaaggugaacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacccagccguccgcccccagcacggaggcgacccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6387 - RNA, 482 nt, Artificial Sequence
  mRNA product Design3 comprising derived and/or modified sequence from Lassa virus__AIT17754__Z (opt1)
gggagaaagcuuaccaugggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccuccgcccagccgagcgcccccuccacggaggccgcgcagaacaccgccccgccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6388 - RNA, 482 nt, Artificial Sequence
  mRNA product Design3 comprising derived and/or modified sequence from Lassa virus__AIT17760__Z (opt1)
gggagaaagcuuaccaugggcaaccgccaggccaagagcacccggaccgacgagcaccagcgcgcccaccuggugcccgacgcgucccaccucgggccccaguucugcaagagcugcugguucgagaacaagggccuggucgagugcaacaaccacuaccugugccucaacugccugucccugcuccugagcguguccagccggugccccaucugcaagaugccccugcccacgaagcucaaggccgccgcccagccguccgcccccagcaccgaggcggggcagaacaccgccccgccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6389 - RNA, 482 nt, Artificial Sequence
  mRNA product Design3 comprising derived and/or modified sequence from Lassa virus__AIT17768__Z (opt1)
gggagaaagcuuaccaugggcaaccgccaggccaagagcgccaccguggacgagugccagcgggcgcaccugguccccgacgccuccuaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccgccgcccagccguccgcgcccagcacgcgggccacccagaacaccaccccgccgcccuacacgcccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6390 - RNA, 482 nt, Artificial Sequence
  mRNA product Design3 comprising derived and/or modified sequence from Lassa virus__AIT17776__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaacaagggccugguggagugcaacaaccacuaccugugccucaacugccugucccugcuccugagcguguccagccggugccccaucugcaagaugccccugcccacccgccucaaggccgccgcccagccguccgcccccagcacggaggcgacccagaacgccgccccgccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6391 - RNA, 482 nt, Artificial Sequence
  mRNA product Design3 comprising derived and/or modified sequence from Lassa virus__AIT17780__Z (opt1)
gggagaaagcuuaccaugggcaaccgccagaccaagagcaccaagguggacgagcaccagcgggccuaccugguccccgacgccucccuccuggggccccaguucugcaagagcugcugguucgagaacaagggccugguggagugcaacaaccacuaccucugccugaacugccugucccuccugcugagcguguccagccgcugccccaucugcaagaugccccuccccacgcggcugaaggcggccgcccagcccuccgccccgcccaccgaggccauccagaacaccacgccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6392 - RNA, 482 nt, Artificial Sequence
  mRNA product Design3 comprising derived and/or modified sequence from Lassa virus__AIT17784__Z (opt1)
gggagaaagcuuaccaugggcaaccgccagaccaagcccaccaagguggacgagcaccagcgggcccaccuggucccggacgccagccaccucgggccccaguucugcaaguccugcugguucgagaacaagggccugguggagugcaacaaccacuaccugugccucaacugccugagccugcuccuguccgugagcucccgcugccccaucugcaagaugccccugccgacgaagcucaaggcgaccgcccagcccagcgcccccuccaccgaggccgcccagaacaccgcgcccccgcccuacgcccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6393 - RNA, 482 nt, Artificial Sequence
  mRNA product Design3 comprising derived and/or modified sequence from Lassa virus__AIT17788__Z (opt1)
gggagaaagcuuaccaugggcaaccgccaggucaagagcaccaagguggacgagcaccagcgggcccaccuggugcccgacgccucccaccucgggccccaguucugcaagagcugcugguucgagaaccgcggccugguggagugcaacaaccacuaccugugccucaacugccugucccugcuccugagcgucuccagccggugccccaucugcaagaugccccugcccaccaagcucaaggcggccacgcagccguccgccccgcccaccgaggccacccagaagaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6394 - RNA, 482 nt, Artificial Sequence
  mRNA product Design3 comprising derived and/or modified sequence from Lassa virus__AIT17792__Z (opt1)
gggagaaagcuuaccaugggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccgggcgcugccccaucugcaagaugccccugcccaccaagcucaaggccacggcccagccgagcgcccccuccaccgaggccacccagaacaccacgcccccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6395 - RNA, 482 nt, Artificial Sequence
  mRNA product Design3 comprising derived and/or modified sequence from Lassa virus__AIT17796__Z (opt1)
gggagaaagcuuaccaugggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccgcccagccguccgcccccagcacggaggcgauccagaacaccaccccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6396 - RNA, 482 nt, Artificial Sequence
  mRNA product Design3 comprising derived and/or modified sequence from Lassa virus__AIT17800__Z (opt1)
gggagaaagcuuaccaugggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccgcugcccacgaagcuccgccccuccgccacccccaccgccccgcccaccgaggcggccgacagcauccggcccccgcccuaccaccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6397 - RNA, 482 nt, Artificial Sequence
  mRNA product Design3 comprising derived and/or modified sequence from Lassa virus__AIT17804__Z (opt1)
gggagaaagcuuaccaugggcaacaagcaggccaaggccagcgaggagaagaacagcccccgcgccucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcaccacccccaccgcgcccccgacgggggccgccgacuccauccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6398 - RNA, 482 nt, Artificial Sequence
  mRNA product Design3 comprising derived and/or modified sequence from Lassa virus__AIT17808__Z (opt1)
gggagaaagcuuaccaugggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgcgccuccggcccagcgccgcccccaccgccccgcccaccggggcggccgacuccacccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6399 - RNA, 485 nt, Artificial Sequence
  mRNA product Design3 comprising derived and/or modified sequence from Lassa virus__AIT17834__Z (opt1)
gggagaaagcuuaccaugggcaacaagcagacccgcagcccgcccaagcccgagcacccccggcccacccugcuccccgacgccucccaccuggggccccaguucugcaagagcugcugguucgagaacaagggccugguggagugcaacaaccacuaccucugccugaacugccugacgcuccugcuguccgucagcgaccgcugccccaucugcaagaugccccuccccaccaagcuggccgugcggacccagcccuccgcgccgccccugaaccaggggaacacccagagcagcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6400 - RNA, 482 nt, Artificial Sequence
  mRNA product Design3 comprising derived and/or modified sequence from Lassa virus__AIT17838__Z (opt1)
gggagaaagcuuaccaugggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccgcugccccaucugcaagaugccgcugcccacgaagcucaagcccagcgccgcccccaccgccccgcccaccggggccgcggacuccauccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6401 - RNA, 482 nt, Artificial Sequence
  mRNA product Design3 comprising derived and/or modified sequence from Lassa virus__AIT17842__Z (opt1)
gggagaaagcuuaccaugggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccggugccccaucugcaagaugccgcugcccacgaagcuccgccccagcgccgcccccaccgccccgcccaccgggguggccgacuccauccggcccccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6402 - RNA, 482 nt, Artificial Sequence
  mRNA product Design3 comprising derived and/or modified sequence from Lassa virus__ANH09743__Z (opt1)
gggagaaagcuuaccaugggcaacaagcaggccaaggccagcgagguggaggacgggccccgcgccucccugauccccgacgccacccaccucggcccccaguucugcaagagcugcugguucgagaacaagucccuggucgagugcaacaaccacuaccugugccucaacugccugacccugcuccugagcguguccaaccggugccccaucugcaagaugccccugccgacgcgccucaagcccagcgugguccccaccgcgcccccgacccgggccggggacggcacccgcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6403 - RNA, 482 nt, Artificial Sequence
  mRNA product Design3 comprising derived and/or modified sequence from Lassa virus__ANH09745__Z (opt1)
gggagaaagcuuaccaugggcaacaagcagaccaaggcccccgagguggaggacgggccccgcgccagccugauccccgacgcgacccaccucggcccccaguucugcaaguccugcugguucgagaacaaggggcuggucgagugcaacaaccacuaccugugccucaacugccugacgcugcuccugagcguguccagccggugccccaucugcaagaugccgcugcccacccgccucaagcccuccaucgugcccaccgccccgcccgcccggaccggcgagaacacgcgcccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6404 - RNA, 482 nt, Artificial Sequence
  mRNA product Design3 comprising derived and/or modified sequence from Lassa virus__ANH09749__Z (opt1)
gggagaaagcuuaccaugggcaacaagcaggccaaggcccccgagguggaggacgggccccgcgcgagccugauccccgacgccacccaccucggcccccaguucugcaaguccugcugguucgagaaccgggggcuggucgagugcaacaaccacuaccugugccucaacugccugacccugcuccugagcguguccaaccgcugccccaucugcaagaugccgcugcccacgcggcucaagcccagcgugguccccaccgccccgcccaccggcgccgggggcgacacccgcccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6405 - RNA, 482 nt, Artificial Sequence
  mRNA product Design3 comprising derived and/or modified sequence from Lassa virus__ANH09751__Z (opt1)
gggagaaagcuuaccaugggcaacaagcaggccaaggcccccaaggcggaggacgggccgcgcgccagccugauccccgacgccacccaccucggcccccaguucugcaaguccugcugguucgagaacaaggggcugguggagugcaacaaccacuaccugugccucaacugccugacccugcuccugagcgucuccaaccggugccccaucugcaagaugccgcugcccacgcgccucaagcccagcguggugcccaccgccccgcccaccggcgccgggggcgacacccggcccccgccccacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6406 - RNA, 482 nt, Artificial Sequence
  mRNA product Design3 comprising derived and/or modified sequence from Lassa virus__ANH09753__Z (opt1)
gggagaaagcuuaccaugggcaacaagcaggccaaggccagcgaggcggaggacgggccccgcgccucccugauccccgacgccacccaccucggcccccaguucugcaagagcugcugguucgagaacaaggggcugguggagugcaacaaccacuaccugugccucaacugccugacccugcuccuguccgucagcucccggugccccaucugcaagaugccccugccgacgcgccuccggcccagcguggugcccaccgcccccuccgccggcgcgggggacggcacccgcccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6407 - RNA, 482 nt, Artificial Sequence
  mRNA product Design3 comprising derived and/or modified sequence from Lassa virus__ANH09755__Z (opt1)
gggagaaagcuuaccaugggcaacaagcagaccaagaccaucaagaagacggacagcccccgcgccucccugauccccgacgccagccacauggggccccaguucugcaaguccugcugguucgagaaccggggccucguggagugcaacaaccacuaccugugccugaacugccucagccugcugcucuccgucagcaaccgcugccccaucugcaagaugccccugccgaccaagcugcgggcgucccccagccccaccgcccccuccauccgcgaggccaacaucaccaacccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6408 - RNA, 482 nt, Artificial Sequence
  mRNA product Design3 comprising derived and/or modified sequence from Lassa virus__ANH09759__Z (opt1)
gggagaaagcuuaccaugggcaacaagcagaccaagaccacgaagaagaccgacagcccccgcgccucccugauccccgacgccagccacauggggccccaguucugcaaguccugcugguucgagaaccggggccucguggagugcaacaaccacuaccugugccugaacugccucagccugcugcucuccgucagcaaccgcugccccaucugcaagaugccccugccgaccaagcugcgggcgucccccagccccaccgcccccuccauccgcgaggccaacaucacgaacccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6409 - RNA, 482 nt, Artificial Sequence
  mRNA product Design3 comprising derived and/or modified sequence from Lassa virus__ANH09761__Z (opt1)
gggagaaagcuuaccaugggcaacaaggggaccaagcccacccagaacagcgagcccucccgcgccaaccuggugcccgacgccagcuaccucggcccccaguucugcaaguccugcugguucgagaacaaggggcuggucgagugcaacaaccacuaccugugccucaacugccugacgaugcugcucagcguguccaaccggugccccaucugcaagaugccgcugcccaccaagaucaaggccagcggcucccccagcgcgcccccgaccgaggccaacuccgccgugagcccgccgcccuacacccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6410 - RNA, 482 nt, Artificial Sequence
  mRNA product Design3 comprising derived and/or modified sequence from Lassa virus__AMR44579__Z (opt1)
gggagaaagcuuaccaugggcgcccgccagaccaagcagccccagaucgaggggagcccccgggccucccuggugcccgacgcgagccaccucggcccccaguucugcaaguccugcugguucgagaacaaggggcuggucgagugcaacaaccacuaccugugccucaacugccugagccugcuccuguccgugagcaaccgcugccccaucugcaagaugccgcugcccaccaagcuccggguguccagcgcccccuccgcgcccccggccgccacggcccagcccggcaccccgccgcccuacagccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6411 - RNA, 482 nt, Artificial Sequence
  mRNA product Design3 comprising derived and/or modified sequence from Lassa virus__AMZ00378__Z (opt1)
gggagaaagcuuaccaugggcaaccgccagaccaaggccaccgaggccaaggacagcccccgggcgucccugauccccgacgccacgcaccucgggccccaguucugcaagagcugcugguucgagaacaagggccugguggagugcaacaaccacuaccugugccucaacugccugacccugcuccuguccgucagcucccgcugccccaucugcaagaugccccugccgacccggcucaagagcuccaccaaccccacggcccccagcgccaagaccgaguccagcaucaacccgccgcccuacucccccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6412 - RNA, 99 nt, Artificial Sequence
  3'-end A75-histoneSL
aaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6413 - RNA, 102 nt, Artificial Sequence
  3'-end U3-A75-histoneSL
uuuaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6414 - RNA, 178 nt, Artificial Sequence
  3'-end A154-histoneSL
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 6415 - RNA, 181 nt, Artificial Sequence
  3'-end U3-A154-histoneSL
uuuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca
